United States Patent 11,028,394 (CRISPR/CAS-RELATED METHODS AND COMPOSITIONS FOR TREATING CYSTIC FIBROSIS) - sequence listing, part 2

SEQ ID NO: 2730 - RNA, 19 nt, Artificial Sequence
  Synthetic
auacagaauauaugugcca

SEQ ID NO: 2731 - RNA, 21 nt, Artificial Sequence
  Synthetic
cgauacagaauauaugugcca

SEQ ID NO: 2732 - RNA, 22 nt, Artificial Sequence
  Synthetic
acgauacagaauauaugugcca

SEQ ID NO: 2733 - RNA, 23 nt, Artificial Sequence
  Synthetic
uacgauacagaauauaugugcca

SEQ ID NO: 2734 - RNA, 24 nt, Artificial Sequence
  Synthetic
guacgauacagaauauaugugcca

SEQ ID NO: 2735 - RNA, 18 nt, Artificial Sequence
  Synthetic
ugccauggggccugugca

SEQ ID NO: 2736 - RNA, 19 nt, Artificial Sequence
  Synthetic
gugccauggggccugugca

SEQ ID NO: 2737 - RNA, 21 nt, Artificial Sequence
  Synthetic
augugccauggggccugugca

SEQ ID NO: 2738 - RNA, 22 nt, Artificial Sequence
  Synthetic
uaugugccauggggccugugca

SEQ ID NO: 2739 - RNA, 23 nt, Artificial Sequence
  Synthetic
auaugugccauggggccugugca

SEQ ID NO: 2740 - RNA, 24 nt, Artificial Sequence
  Synthetic
uauaugugccauggggccugugca

SEQ ID NO: 2741 - RNA, 18 nt, Artificial Sequence
  Synthetic
uccuuguuauccggguca

SEQ ID NO: 2742 - RNA, 19 nt, Artificial Sequence
  Synthetic
cuccuuguuauccggguca

SEQ ID NO: 2743 - RNA, 20 nt, Artificial Sequence
  Synthetic
ccuccuuguuauccggguca

SEQ ID NO: 2744 - RNA, 21 nt, Artificial Sequence
  Synthetic
uccuccuuguuauccggguca

SEQ ID NO: 2745 - RNA, 22 nt, Artificial Sequence
  Synthetic
uuccuccuuguuauccggguca

SEQ ID NO: 2746 - RNA, 23 nt, Artificial Sequence
  Synthetic
guuccuccuuguuauccggguca

SEQ ID NO: 2747 - RNA, 24 nt, Artificial Sequence
  Synthetic
uguuccuccuuguuauccggguca

SEQ ID NO: 2748 - RNA, 18 nt, Artificial Sequence
  Synthetic
agcaguguccucacaaua

SEQ ID NO: 2749 - RNA, 19 nt, Artificial Sequence
  Synthetic
gagcaguguccucacaaua

SEQ ID NO: 2750 - RNA, 20 nt, Artificial Sequence
  Synthetic
ggagcaguguccucacaaua

SEQ ID NO: 2751 - RNA, 21 nt, Artificial Sequence
  Synthetic
aggagcaguguccucacaaua

SEQ ID NO: 2752 - RNA, 22 nt, Artificial Sequence
  Synthetic
uaggagcaguguccucacaaua

SEQ ID NO: 2753 - RNA, 23 nt, Artificial Sequence
  Synthetic
guaggagcaguguccucacaaua

SEQ ID NO: 2754 - RNA, 24 nt, Artificial Sequence
  Synthetic
uguaggagcaguguccucacaaua

SEQ ID NO: 2755 - RNA, 18 nt, Artificial Sequence
  Synthetic
acuuaaaaugaguuuaua

SEQ ID NO: 2756 - RNA, 19 nt, Artificial Sequence
  Synthetic
gacuuaaaaugaguuuaua

SEQ ID NO: 2757 - RNA, 20 nt, Artificial Sequence
  Synthetic
agacuuaaaaugaguuuaua

SEQ ID NO: 2758 - RNA, 21 nt, Artificial Sequence
  Synthetic
gagacuuaaaaugaguuuaua

SEQ ID NO: 2759 - RNA, 22 nt, Artificial Sequence
  Synthetic
ggagacuuaaaaugaguuuaua

SEQ ID NO: 2760 - RNA, 23 nt, Artificial Sequence
  Synthetic
aggagacuuaaaaugaguuuaua

SEQ ID NO: 2761 - RNA, 24 nt, Artificial Sequence
  Synthetic
gaggagacuuaaaaugaguuuaua

SEQ ID NO: 2762 - RNA, 18 nt, Artificial Sequence
  Synthetic
caagacuuuucaucuuua

SEQ ID NO: 2763 - RNA, 19 nt, Artificial Sequence
  Synthetic
acaagacuuuucaucuuua

SEQ ID NO: 2764 - RNA, 20 nt, Artificial Sequence
  Synthetic
cacaagacuuuucaucuuua

SEQ ID NO: 2765 - RNA, 21 nt, Artificial Sequence
  Synthetic
acacaagacuuuucaucuuua

SEQ ID NO: 2766 - RNA, 22 nt, Artificial Sequence
  Synthetic
aacacaagacuuuucaucuuua

SEQ ID NO: 2767 - RNA, 23 nt, Artificial Sequence
  Synthetic
caacacaagacuuuucaucuuua

SEQ ID NO: 2768 - RNA, 24 nt, Artificial Sequence
  Synthetic
ucaacacaagacuuuucaucuuua

SEQ ID NO: 2769 - RNA, 18 nt, Artificial Sequence
  Synthetic
uauuucucauaaaauacc

SEQ ID NO: 2770 - RNA, 19 nt, Artificial Sequence
  Synthetic
uuauuucucauaaaauacc

SEQ ID NO: 2771 - RNA, 20 nt, Artificial Sequence
  Synthetic
uuuauuucucauaaaauacc

SEQ ID NO: 2772 - RNA, 21 nt, Artificial Sequence
  Synthetic
auuuauuucucauaaaauacc

SEQ ID NO: 2773 - RNA, 22 nt, Artificial Sequence
  Synthetic
cauuuauuucucauaaaauacc

SEQ ID NO: 2774 - RNA, 23 nt, Artificial Sequence
  Synthetic
ucauuuauuucucauaaaauacc

SEQ ID NO: 2775 - RNA, 24 nt, Artificial Sequence
  Synthetic
uucauuuauuucucauaaaauacc

SEQ ID NO: 2776 - RNA, 18 nt, Artificial Sequence
  Synthetic
auacagaauauaugugcc

SEQ ID NO: 2777 - RNA, 19 nt, Artificial Sequence
  Synthetic
gauacagaauauaugugcc

SEQ ID NO: 2778 - RNA, 20 nt, Artificial Sequence
  Synthetic
cgauacagaauauaugugcc

SEQ ID NO: 2779 - RNA, 21 nt, Artificial Sequence
  Synthetic
acgauacagaauauaugugcc

SEQ ID NO: 2780 - RNA, 22 nt, Artificial Sequence
  Synthetic
uacgauacagaauauaugugcc

SEQ ID NO: 2781 - RNA, 23 nt, Artificial Sequence
  Synthetic
guacgauacagaauauaugugcc

SEQ ID NO: 2782 - RNA, 24 nt, Artificial Sequence
  Synthetic
uguacgauacagaauauaugugcc

SEQ ID NO: 2783 - RNA, 18 nt, Artificial Sequence
  Synthetic
gugccauggggccugugc

SEQ ID NO: 2784 - RNA, 19 nt, Artificial Sequence
  Synthetic
ugugccauggggccugugc

SEQ ID NO: 2785 - RNA, 20 nt, Artificial Sequence
  Synthetic
augugccauggggccugugc

SEQ ID NO: 2786 - RNA, 21 nt, Artificial Sequence
  Synthetic
uaugugccauggggccugugc

SEQ ID NO: 2787 - RNA, 22 nt, Artificial Sequence
  Synthetic
auaugugccauggggccugugc

SEQ ID NO: 2788 - RNA, 23 nt, Artificial Sequence
  Synthetic
uauaugugccauggggccugugc

SEQ ID NO: 2789 - RNA, 24 nt, Artificial Sequence
  Synthetic
auauaugugccauggggccugugc

SEQ ID NO: 2790 - RNA, 18 nt, Artificial Sequence
  Synthetic
ggugacuuccuacaaaag

SEQ ID NO: 2791 - RNA, 19 nt, Artificial Sequence
  Synthetic
uggugacuuccuacaaaag

SEQ ID NO: 2792 - RNA, 21 nt, Artificial Sequence
  Synthetic
uuuggugacuuccuacaaaag

SEQ ID NO: 2793 - RNA, 22 nt, Artificial Sequence
  Synthetic
cuuuggugacuuccuacaaaag

SEQ ID NO: 2794 - RNA, 23 nt, Artificial Sequence
  Synthetic
gcuuuggugacuuccuacaaaag

SEQ ID NO: 2795 - RNA, 24 nt, Artificial Sequence
  Synthetic
ugcuuuggugacuuccuacaaaag

SEQ ID NO: 2796 - RNA, 18 nt, Artificial Sequence
  Synthetic
aagacuuuucaucuuuag

SEQ ID NO: 2797 - RNA, 19 nt, Artificial Sequence
  Synthetic
caagacuuuucaucuuuag

SEQ ID NO: 2798 - RNA, 21 nt, Artificial Sequence
  Synthetic
cacaagacuuuucaucuuuag

SEQ ID NO: 2799 - RNA, 22 nt, Artificial Sequence
  Synthetic
acacaagacuuuucaucuuuag

SEQ ID NO: 2800 - RNA, 23 nt, Artificial Sequence
  Synthetic
aacacaagacuuuucaucuuuag

SEQ ID NO: 2801 - RNA, 24 nt, Artificial Sequence
  Synthetic
caacacaagacuuuucaucuuuag

SEQ ID NO: 2802 - RNA, 18 nt, Artificial Sequence
  Synthetic
gccaaaaauggcugggug

SEQ ID NO: 2803 - RNA, 19 nt, Artificial Sequence
  Synthetic
ggccaaaaauggcugggug

SEQ ID NO: 2804 - RNA, 20 nt, Artificial Sequence
  Synthetic
aggccaaaaauggcugggug

SEQ ID NO: 2805 - RNA, 21 nt, Artificial Sequence
  Synthetic
aaggccaaaaauggcugggug

SEQ ID NO: 2806 - RNA, 22 nt, Artificial Sequence
  Synthetic
gaaggccaaaaauggcugggug

SEQ ID NO: 2807 - RNA, 23 nt, Artificial Sequence
  Synthetic
ugaaggccaaaaauggcugggug

SEQ ID NO: 2808 - RNA, 24 nt, Artificial Sequence
  Synthetic
augaaggccaaaaauggcugggug

SEQ ID NO: 2809 - RNA, 18 nt, Artificial Sequence
  Synthetic
caucugcauuccaaugug

SEQ ID NO: 2810 - RNA, 19 nt, Artificial Sequence
  Synthetic
ucaucugcauuccaaugug

SEQ ID NO: 2811 - RNA, 20 nt, Artificial Sequence
  Synthetic
cucaucugcauuccaaugug

SEQ ID NO: 2812 - RNA, 21 nt, Artificial Sequence
  Synthetic
ucucaucugcauuccaaugug

SEQ ID NO: 2813 - RNA, 22 nt, Artificial Sequence
  Synthetic
uucucaucugcauuccaaugug

SEQ ID NO: 2814 - RNA, 23 nt, Artificial Sequence
  Synthetic
auucucaucugcauuccaaugug

SEQ ID NO: 2815 - RNA, 24 nt, Artificial Sequence
  Synthetic
uauucucaucugcauuccaaugug

SEQ ID NO: 2816 - RNA, 18 nt, Artificial Sequence
  Synthetic
ccuuguuauccgggucau

SEQ ID NO: 2817 - RNA, 19 nt, Artificial Sequence
  Synthetic
uccuuguuauccgggucau

SEQ ID NO: 2818 - RNA, 21 nt, Artificial Sequence
  Synthetic
ccuccuuguuauccgggucau

SEQ ID NO: 2819 - RNA, 22 nt, Artificial Sequence
  Synthetic
uccuccuuguuauccgggucau

SEQ ID NO: 2820 - RNA, 23 nt, Artificial Sequence
  Synthetic
uuccuccuuguuauccgggucau

SEQ ID NO: 2821 - RNA, 24 nt, Artificial Sequence
  Synthetic
guuccuccuuguuauccgggucau

SEQ ID NO: 2822 - RNA, 18 nt, Artificial Sequence
  Synthetic
gcuaugauucuucccagu

SEQ ID NO: 2823 - RNA, 19 nt, Artificial Sequence
  Synthetic
agcuaugauucuucccagu

SEQ ID NO: 2824 - RNA, 20 nt, Artificial Sequence
  Synthetic
aagcuaugauucuucccagu

SEQ ID NO: 2825 - RNA, 21 nt, Artificial Sequence
  Synthetic
gaagcuaugauucuucccagu

SEQ ID NO: 2826 - RNA, 22 nt, Artificial Sequence
  Synthetic
ggaagcuaugauucuucccagu

SEQ ID NO: 2827 - RNA, 23 nt, Artificial Sequence
  Synthetic
aggaagcuaugauucuucccagu

SEQ ID NO: 2828 - RNA, 24 nt, Artificial Sequence
  Synthetic
uaggaagcuaugauucuucccagu

SEQ ID NO: 2829 - RNA, 18 nt, Artificial Sequence
  Synthetic
ccaaaaauggcugggugu

SEQ ID NO: 2830 - RNA, 19 nt, Artificial Sequence
  Synthetic
gccaaaaauggcugggugu

SEQ ID NO: 2831 - RNA, 21 nt, Artificial Sequence
  Synthetic
aggccaaaaauggcugggugu

SEQ ID NO: 2832 - RNA, 22 nt, Artificial Sequence
  Synthetic
aaggccaaaaauggcugggugu

SEQ ID NO: 2833 - RNA, 23 nt, Artificial Sequence
  Synthetic
gaaggccaaaaauggcugggugu

SEQ ID NO: 2834 - RNA, 24 nt, Artificial Sequence
  Synthetic
ugaaggccaaaaauggcugggugu

SEQ ID NO: 2835 - RNA, 18 nt, Artificial Sequence
  Synthetic
cacaagacuuuucaucuu

SEQ ID NO: 2836 - RNA, 19 nt, Artificial Sequence
  Synthetic
acacaagacuuuucaucuu

SEQ ID NO: 2837 - RNA, 20 nt, Artificial Sequence
  Synthetic
aacacaagacuuuucaucuu

SEQ ID NO: 2838 - RNA, 21 nt, Artificial Sequence
  Synthetic
caacacaagacuuuucaucuu

SEQ ID NO: 2839 - RNA, 22 nt, Artificial Sequence
  Synthetic
ucaacacaagacuuuucaucuu

SEQ ID NO: 2840 - RNA, 23 nt, Artificial Sequence
  Synthetic
uucaacacaagacuuuucaucuu

SEQ ID NO: 2841 - RNA, 24 nt, Artificial Sequence
  Synthetic
uuucaacacaagacuuuucaucuu

SEQ ID NO: 2842 - RNA, 18 nt, Artificial Sequence
  Synthetic
guauuuuaugagaaauaa

SEQ ID NO: 2843 - RNA, 19 nt, Artificial Sequence
  Synthetic
gguauuuuaugagaaauaa

SEQ ID NO: 2844 - RNA, 20 nt, Artificial Sequence
  Synthetic
ggguauuuuaugagaaauaa

SEQ ID NO: 2845 - RNA, 21 nt, Artificial Sequence
  Synthetic
aggguauuuuaugagaaauaa

SEQ ID NO: 2846 - RNA, 22 nt, Artificial Sequence
  Synthetic
caggguauuuuaugagaaauaa

SEQ ID NO: 2847 - RNA, 23 nt, Artificial Sequence
  Synthetic
ucaggguauuuuaugagaaauaa

SEQ ID NO: 2848 - RNA, 24 nt, Artificial Sequence
  Synthetic
cucaggguauuuuaugagaaauaa

SEQ ID NO: 2849 - RNA, 18 nt, Artificial Sequence
  Synthetic
ccuaugacccggauaaca

SEQ ID NO: 2850 - RNA, 19 nt, Artificial Sequence
  Synthetic
uccuaugacccggauaaca

SEQ ID NO: 2851 - RNA, 21 nt, Artificial Sequence
  Synthetic
cuuccuaugacccggauaaca

SEQ ID NO: 2852 - RNA, 22 nt, Artificial Sequence
  Synthetic
gcuuccuaugacccggauaaca

SEQ ID NO: 2853 - RNA, 23 nt, Artificial Sequence
  Synthetic
agcuuccuaugacccggauaaca

SEQ ID NO: 2854 - RNA, 24 nt, Artificial Sequence
  Synthetic
uagcuuccuaugacccggauaaca

SEQ ID NO: 2855 - RNA, 18 nt, Artificial Sequence
  Synthetic
uuuuuggccuucaucaca

SEQ ID NO: 2856 - RNA, 19 nt, Artificial Sequence
  Synthetic
auuuuuggccuucaucaca

SEQ ID NO: 2857 - RNA, 20 nt, Artificial Sequence
  Synthetic
cauuuuuggccuucaucaca

SEQ ID NO: 2858 - RNA, 21 nt, Artificial Sequence
  Synthetic
ccauuuuuggccuucaucaca

SEQ ID NO: 2859 - RNA, 22 nt, Artificial Sequence
  Synthetic
gccauuuuuggccuucaucaca

SEQ ID NO: 2860 - RNA, 23 nt, Artificial Sequence
  Synthetic
agccauuuuuggccuucaucaca

SEQ ID NO: 2861 - RNA, 24 nt, Artificial Sequence
  Synthetic
cagccauuuuuggccuucaucaca

SEQ ID NO: 2862 - RNA, 18 nt, Artificial Sequence
  Synthetic
gcaguacagccucucuua

SEQ ID NO: 2863 - RNA, 19 nt, Artificial Sequence
  Synthetic
agcaguacagccucucuua

SEQ ID NO: 2864 - RNA, 20 nt, Artificial Sequence
  Synthetic
aagcaguacagccucucuua

SEQ ID NO: 2865 - RNA, 21 nt, Artificial Sequence
  Synthetic
aaagcaguacagccucucuua

SEQ ID NO: 2866 - RNA, 22 nt, Artificial Sequence
  Synthetic
caaagcaguacagccucucuua

SEQ ID NO: 2867 - RNA, 23 nt, Artificial Sequence
  Synthetic
ccaaagcaguacagccucucuua

SEQ ID NO: 2868 - RNA, 24 nt, Artificial Sequence
  Synthetic
accaaagcaguacagccucucuua

SEQ ID NO: 2869 - RNA, 18 nt, Artificial Sequence
  Synthetic
uccuaugacccggauaac

SEQ ID NO: 2870 - RNA, 19 nt, Artificial Sequence
  Synthetic
uuccuaugacccggauaac

SEQ ID NO: 2871 - RNA, 20 nt, Artificial Sequence
  Synthetic
cuuccuaugacccggauaac

SEQ ID NO: 2872 - RNA, 21 nt, Artificial Sequence
  Synthetic
gcuuccuaugacccggauaac

SEQ ID NO: 2873 - RNA, 22 nt, Artificial Sequence
  Synthetic
agcuuccuaugacccggauaac

SEQ ID NO: 2874 - RNA, 23 nt, Artificial Sequence
  Synthetic
uagcuuccuaugacccggauaac

SEQ ID NO: 2875 - RNA, 24 nt, Artificial Sequence
  Synthetic
auagcuuccuaugacccggauaac

SEQ ID NO: 2876 - RNA, 18 nt, Artificial Sequence
  Synthetic
caguacagccucucuuac

SEQ ID NO: 2877 - RNA, 19 nt, Artificial Sequence
  Synthetic
gcaguacagccucucuuac

SEQ ID NO: 2878 - RNA, 21 nt, Artificial Sequence
  Synthetic
aagcaguacagccucucuuac

SEQ ID NO: 2879 - RNA, 22 nt, Artificial Sequence
  Synthetic
aaagcaguacagccucucuuac

SEQ ID NO: 2880 - RNA, 23 nt, Artificial Sequence
  Synthetic
caaagcaguacagccucucuuac

SEQ ID NO: 2881 - RNA, 24 nt, Artificial Sequence
  Synthetic
ccaaagcaguacagccucucuuac

SEQ ID NO: 2882 - RNA, 18 nt, Artificial Sequence
  Synthetic
uuuaagucuccucuaaag

SEQ ID NO: 2883 - RNA, 19 nt, Artificial Sequence
  Synthetic
uuuuaagucuccucuaaag

SEQ ID NO: 2884 - RNA, 20 nt, Artificial Sequence
  Synthetic
auuuuaagucuccucuaaag

SEQ ID NO: 2885 - RNA, 21 nt, Artificial Sequence
  Synthetic
cauuuuaagucuccucuaaag

SEQ ID NO: 2886 - RNA, 22 nt, Artificial Sequence
  Synthetic
ucauuuuaagucuccucuaaag

SEQ ID NO: 2887 - RNA, 23 nt, Artificial Sequence
  Synthetic
cucauuuuaagucuccucuaaag

SEQ ID NO: 2888 - RNA, 24 nt, Artificial Sequence
  Synthetic
acucauuuuaagucuccucuaaag

SEQ ID NO: 2889 - RNA, 18 nt, Artificial Sequence
  Synthetic
uaugacccggauaacaag

SEQ ID NO: 2890 - RNA, 19 nt, Artificial Sequence
  Synthetic
cuaugacccggauaacaag

SEQ ID NO: 2891 - RNA, 20 nt, Artificial Sequence
  Synthetic
ccuaugacccggauaacaag

SEQ ID NO: 2892 - RNA, 21 nt, Artificial Sequence
  Synthetic
uccuaugacccggauaacaag

SEQ ID NO: 2893 - RNA, 22 nt, Artificial Sequence
  Synthetic
uuccuaugacccggauaacaag

SEQ ID NO: 2894 - RNA, 23 nt, Artificial Sequence
  Synthetic
cuuccuaugacccggauaacaag

SEQ ID NO: 2895 - RNA, 24 nt, Artificial Sequence
  Synthetic
gcuuccuaugacccggauaacaag

SEQ ID NO: 2896 - RNA, 18 nt, Artificial Sequence
  Synthetic
caucacauuggaaugcag

SEQ ID NO: 2897 - RNA, 19 nt, Artificial Sequence
  Synthetic
ucaucacauuggaaugcag

SEQ ID NO: 2898 - RNA, 20 nt, Artificial Sequence
  Synthetic
uucaucacauuggaaugcag

SEQ ID NO: 2899 - RNA, 21 nt, Artificial Sequence
  Synthetic
cuucaucacauuggaaugcag

SEQ ID NO: 2900 - RNA, 22 nt, Artificial Sequence
  Synthetic
ccuucaucacauuggaaugcag

SEQ ID NO: 2901 - RNA, 23 nt, Artificial Sequence
  Synthetic
gccuucaucacauuggaaugcag

SEQ ID NO: 2902 - RNA, 24 nt, Artificial Sequence
  Synthetic
ggccuucaucacauuggaaugcag

SEQ ID NO: 2903 - RNA, 18 nt, Artificial Sequence
  Synthetic
augacccggauaacaagg

SEQ ID NO: 2904 - RNA, 19 nt, Artificial Sequence
  Synthetic
uaugacccggauaacaagg

SEQ ID NO: 2905 - RNA, 21 nt, Artificial Sequence
  Synthetic
ccuaugacccggauaacaagg

SEQ ID NO: 2906 - RNA, 22 nt, Artificial Sequence
  Synthetic
uccuaugacccggauaacaagg

SEQ ID NO: 2907 - RNA, 23 nt, Artificial Sequence
  Synthetic
uuccuaugacccggauaacaagg

SEQ ID NO: 2908 - RNA, 24 nt, Artificial Sequence
  Synthetic
cuuccuaugacccggauaacaagg

SEQ ID NO: 2909 - RNA, 18 nt, Artificial Sequence
  Synthetic
aagaugaaaagucuugug

SEQ ID NO: 2910 - RNA, 19 nt, Artificial Sequence
  Synthetic
aaagaugaaaagucuugug

SEQ ID NO: 2911 - RNA, 20 nt, Artificial Sequence
  Synthetic
uaaagaugaaaagucuugug

SEQ ID NO: 2912 - RNA, 21 nt, Artificial Sequence
  Synthetic
cuaaagaugaaaagucuugug

SEQ ID NO: 2913 - RNA, 22 nt, Artificial Sequence
  Synthetic
ucuaaagaugaaaagucuugug

SEQ ID NO: 2914 - RNA, 23 nt, Artificial Sequence
  Synthetic
cucuaaagaugaaaagucuugug

SEQ ID NO: 2915 - RNA, 24 nt, Artificial Sequence
  Synthetic
ccucuaaagaugaaaagucuugug

SEQ ID NO: 2916 - RNA, 18 nt, Artificial Sequence
  Synthetic
ucuguuuuuccccuuuug

SEQ ID NO: 2917 - RNA, 19 nt, Artificial Sequence
  Synthetic
cucuguuuuuccccuuuug

SEQ ID NO: 2918 - RNA, 20 nt, Artificial Sequence
  Synthetic
ucucuguuuuuccccuuuug

SEQ ID NO: 2919 - RNA, 21 nt, Artificial Sequence
  Synthetic
uucucuguuuuuccccuuuug

SEQ ID NO: 2920 - RNA, 22 nt, Artificial Sequence
  Synthetic
uuucucuguuuuuccccuuuug

SEQ ID NO: 2921 - RNA, 23 nt, Artificial Sequence
  Synthetic
auuucucuguuuuuccccuuuug

SEQ ID NO: 2922 - RNA, 24 nt, Artificial Sequence
  Synthetic
aauuucucuguuuuuccccuuuug

SEQ ID NO: 2923 - RNA, 18 nt, Artificial Sequence
  Synthetic
auguuuaguuugauuuau

SEQ ID NO: 2924 - RNA, 19 nt, Artificial Sequence
  Synthetic
uauguuuaguuugauuuau

SEQ ID NO: 2925 - RNA, 20 nt, Artificial Sequence
  Synthetic
cuauguuuaguuugauuuau

SEQ ID NO: 2926 - RNA, 21 nt, Artificial Sequence
  Synthetic
gcuauguuuaguuugauuuau

SEQ ID NO: 2927 - RNA, 22 nt, Artificial Sequence
  Synthetic
agcuauguuuaguuugauuuau

SEQ ID NO: 2928 - RNA, 23 nt, Artificial Sequence
  Synthetic
uagcuauguuuaguuugauuuau

SEQ ID NO: 2929 - RNA, 24 nt, Artificial Sequence
  Synthetic
auagcuauguuuaguuugauuuau

SEQ ID NO: 2930 - RNA, 18 nt, Artificial Sequence
  Synthetic
auucucaggguauuuuau

SEQ ID NO: 2931 - RNA, 19 nt, Artificial Sequence
  Synthetic
aauucucaggguauuuuau

SEQ ID NO: 2932 - RNA, 20 nt, Artificial Sequence
  Synthetic
aaauucucaggguauuuuau

SEQ ID NO: 2933 - RNA, 21 nt, Artificial Sequence
  Synthetic
gaaauucucaggguauuuuau

SEQ ID NO: 2934 - RNA, 22 nt, Artificial Sequence
  Synthetic
ugaaauucucaggguauuuuau

SEQ ID NO: 2935 - RNA, 23 nt, Artificial Sequence
  Synthetic
uugaaauucucaggguauuuuau

SEQ ID NO: 2936 - RNA, 24 nt, Artificial Sequence
  Synthetic
guugaaauucucaggguauuuuau

SEQ ID NO: 2937 - RNA, 18 nt, Artificial Sequence
  Synthetic
aguacagccucucuuacu

SEQ ID NO: 2938 - RNA, 19 nt, Artificial Sequence
  Synthetic
caguacagccucucuuacu

SEQ ID NO: 2939 - RNA, 21 nt, Artificial Sequence
  Synthetic
agcaguacagccucucuuacu

SEQ ID NO: 2940 - RNA, 22 nt, Artificial Sequence
  Synthetic
aagcaguacagccucucuuacu

SEQ ID NO: 2941 - RNA, 23 nt, Artificial Sequence
  Synthetic
aaagcaguacagccucucuuacu

SEQ ID NO: 2942 - RNA, 24 nt, Artificial Sequence
  Synthetic
caaagcaguacagccucucuuacu

SEQ ID NO: 2943 - RNA, 18 nt, Artificial Sequence
  Synthetic
augccuucucuuuauugu

SEQ ID NO: 2944 - RNA, 19 nt, Artificial Sequence
  Synthetic
uaugccuucucuuuauugu

SEQ ID NO: 2945 - RNA, 20 nt, Artificial Sequence
  Synthetic
uuaugccuucucuuuauugu

SEQ ID NO: 2946 - RNA, 21 nt, Artificial Sequence
  Synthetic
cuuaugccuucucuuuauugu

SEQ ID NO: 2947 - RNA, 22 nt, Artificial Sequence
  Synthetic
gcuuaugccuucucuuuauugu

SEQ ID NO: 2948 - RNA, 23 nt, Artificial Sequence
  Synthetic
ggcuuaugccuucucuuuauugu

SEQ ID NO: 2949 - RNA, 24 nt, Artificial Sequence
  Synthetic
aggcuuaugccuucucuuuauugu

SEQ ID NO: 2950 - RNA, 18 nt, Artificial Sequence
  Synthetic
cuguuuuuccccuuuugu

SEQ ID NO: 2951 - RNA, 19 nt, Artificial Sequence
  Synthetic
ucuguuuuuccccuuuugu

SEQ ID NO: 2952 - RNA, 21 nt, Artificial Sequence
  Synthetic
ucucuguuuuuccccuuuugu

SEQ ID NO: 2953 - RNA, 22 nt, Artificial Sequence
  Synthetic
uucucuguuuuuccccuuuugu

SEQ ID NO: 2954 - RNA, 23 nt, Artificial Sequence
  Synthetic
uuucucuguuuuuccccuuuugu

SEQ ID NO: 2955 - RNA, 24 nt, Artificial Sequence
  Synthetic
auuucucuguuuuuccccuuuugu

SEQ ID NO: 2956 - RNA, 18 nt, Artificial Sequence
  Synthetic
uuaugccuucucuuuauu

SEQ ID NO: 2957 - RNA, 19 nt, Artificial Sequence
  Synthetic
cuuaugccuucucuuuauu

SEQ ID NO: 2958 - RNA, 20 nt, Artificial Sequence
  Synthetic
gcuuaugccuucucuuuauu

SEQ ID NO: 2959 - RNA, 21 nt, Artificial Sequence
  Synthetic
ggcuuaugccuucucuuuauu

SEQ ID NO: 2960 - RNA, 22 nt, Artificial Sequence
  Synthetic
aggcuuaugccuucucuuuauu

SEQ ID NO: 2961 - RNA, 23 nt, Artificial Sequence
  Synthetic
uaggcuuaugccuucucuuuauu

SEQ ID NO: 2962 - RNA, 24 nt, Artificial Sequence
  Synthetic
auaggcuuaugccuucucuuuauu

SEQ ID NO: 2963 - RNA, 18 nt, Artificial Sequence
  Synthetic
aaauucucaggguauuuu

SEQ ID NO: 2964 - RNA, 19 nt, Artificial Sequence
  Synthetic
gaaauucucaggguauuuu

SEQ ID NO: 2965 - RNA, 20 nt, Artificial Sequence
  Synthetic
ugaaauucucaggguauuuu

SEQ ID NO: 2966 - RNA, 21 nt, Artificial Sequence
  Synthetic
uugaaauucucaggguauuuu

SEQ ID NO: 2967 - RNA, 22 nt, Artificial Sequence
  Synthetic
guugaaauucucaggguauuuu

SEQ ID NO: 2968 - RNA, 23 nt, Artificial Sequence
  Synthetic
uguugaaauucucaggguauuuu

SEQ ID NO: 2969 - RNA, 24 nt, Artificial Sequence
  Synthetic
guguugaaauucucaggguauuuu

SEQ ID NO: 2970 - RNA, 20 nt, Artificial Sequence
  Synthetic
guuauccgggucauaggaag

SEQ ID NO: 2971 - RNA, 17 nt, Artificial Sequence
  Synthetic
ucgcgauuuaucuaggc

SEQ ID NO: 2972 - RNA, 17 nt, Artificial Sequence
  Synthetic
auccgggucauaggaag

SEQ ID NO: 2973 - RNA, 17 nt, Artificial Sequence
  Synthetic
cucuuacugggaagaau

SEQ ID NO: 2974 - RNA, 20 nt, Artificial Sequence
  Synthetic
cuaucgcgauuuaucuaggc

SEQ ID NO: 2975 - RNA, 20 nt, Artificial Sequence
  Synthetic
cuucccaguaagagaggcug

SEQ ID NO: 2976 - RNA, 20 nt, Artificial Sequence
  Synthetic
ccucucuuacugggaagaau

SEQ ID NO: 2977 - RNA, 17 nt, Artificial Sequence
  Synthetic
gagaauagcuauguuua

SEQ ID NO: 2978 - RNA, 20 nt, Artificial Sequence
  Synthetic
gaugagaauagcuauguuua

SEQ ID NO: 2979 - RNA, 17 nt, Artificial Sequence
  Synthetic
caaggaggaacacucua

SEQ ID NO: 2980 - RNA, 17 nt, Artificial Sequence
  Synthetic
cccaguaagagaggcug

SEQ ID NO: 2981 - RNA, 20 nt, Artificial Sequence
  Synthetic
uaacaaggaggaacacucua

SEQ ID NO: 2982 - RNA, 18 nt, Artificial Sequence
  Synthetic
gaguggaggucaaugagc

SEQ ID NO: 2983 - RNA, 19 nt, Artificial Sequence
  Synthetic
ugaguggaggucaaugagc

SEQ ID NO: 2984 - RNA, 20 nt, Artificial Sequence
  Synthetic
cugaguggaggucaaugagc

SEQ ID NO: 2985 - RNA, 21 nt, Artificial Sequence
  Synthetic
acugaguggaggucaaugagc

SEQ ID NO: 2986 - RNA, 22 nt, Artificial Sequence
  Synthetic
cacugaguggaggucaaugagc

SEQ ID NO: 2987 - RNA, 23 nt, Artificial Sequence
  Synthetic
acacugaguggaggucaaugagc

SEQ ID NO: 2988 - RNA, 24 nt, Artificial Sequence
  Synthetic
cacacugaguggaggucaaugagc

SEQ ID NO: 2989 - RNA, 23 nt, Artificial Sequence
  Synthetic
ugagcaagaauuucuuuagcaag

SEQ ID NO: 2990 - RNA, 24 nt, Artificial Sequence
  Synthetic
augagcaagaauuucuuuagcaag

SEQ ID NO: 2991 - RNA, 17 nt, Artificial Sequence
  Synthetic
ucauugaccuccacuca

SEQ ID NO: 2992 - RNA, 20 nt, Artificial Sequence
  Synthetic
ugcucauugaccuccacuca

SEQ ID NO: 2993 - RNA, 17 nt, Artificial Sequence
  Synthetic
gaauuauguuuauggca

SEQ ID NO: 2994 - RNA, 17 nt, Artificial Sequence
  Synthetic
ggagaaauccagaucga

SEQ ID NO: 2995 - RNA, 17 nt, Artificial Sequence
  Synthetic
ggccucuugggaagaac

SEQ ID NO: 2996 - RNA, 17 nt, Artificial Sequence
  Synthetic
guccuuuugcucaccug

SEQ ID NO: 2997 - RNA, 17 nt, Artificial Sequence
  Synthetic
gaucgauggugugucuu

SEQ ID NO: 2998 - RNA, 20 nt, Artificial Sequence
  Synthetic
gaaggagaaauccagaucga

SEQ ID NO: 2999 - RNA, 20 nt, Artificial Sequence
  Synthetic
gugggccucuugggaagaac

SEQ ID NO: 3000 - RNA, 17 nt, Artificial Sequence
  Synthetic
uaccacaggugagcaaa

SEQ ID NO: 3001 - RNA, 17 nt, Artificial Sequence
  Synthetic
cugugguaucacuccaa

SEQ ID NO: 3002 - RNA, 17 nt, Artificial Sequence
  Synthetic
agacuacugaacacuga

SEQ ID NO: 3003 - RNA, 17 nt, Artificial Sequence
  Synthetic
cuauaagguaaaaguga

SEQ ID NO: 3004 - RNA, 17 nt, Artificial Sequence
  Synthetic
uaacuuugcaacaguga

SEQ ID NO: 3005 - RNA, 17 nt, Artificial Sequence
  Synthetic
caagaggcccaccuaua

SEQ ID NO: 3006 - RNA, 17 nt, Artificial Sequence
  Synthetic
cuuuggagugauaccac

SEQ ID NO: 3007 - RNA, 17 nt, Artificial Sequence
  Synthetic
cuaugagaaaacugcac

SEQ ID NO: 3008 - RNA, 17 nt, Artificial Sequence
  Synthetic
aagacacaccaucgauc

SEQ ID NO: 3009 - RNA, 17 nt, Artificial Sequence
  Synthetic
uugggaagaacuggauc

SEQ ID NO: 3010 - RNA, 17 nt, Artificial Sequence
  Synthetic
auccaguucuucccaag

SEQ ID NO: 3011 - RNA, 17 nt, Artificial Sequence
  Synthetic
cacuuuuaccuuauagg

SEQ ID NO: 3012 - RNA, 17 nt, Artificial Sequence
  Synthetic
cagugcaguuuucucau

SEQ ID NO: 3013 - RNA, 17 nt, Artificial Sequence
  Synthetic
uauaagguaaaagugau

SEQ ID NO: 3014 - RNA, 17 nt, Artificial Sequence
  Synthetic
ucacuucugugacauau

SEQ ID NO: 3015 - RNA, 17 nt, Artificial Sequence
  Synthetic
caucacuuuuaccuuau

SEQ ID NO: 3016 - RNA, 17 nt, Artificial Sequence
  Synthetic
cuuauaggugggccucu

SEQ ID NO: 3017 - RNA, 17 nt, Artificial Sequence
  Synthetic
agaucgauggugugucu

SEQ ID NO: 3018 - RNA, 17 nt, Artificial Sequence
  Synthetic
acuuuuaccuuauaggu

SEQ ID NO: 3019 - RNA, 17 nt, Artificial Sequence
  Synthetic
uuauaggugggccucuu

SEQ ID NO: 3020 - RNA, 20 nt, Artificial Sequence
  Synthetic
aaaggacuuagccagaaaaa

SEQ ID NO: 3021 - RNA, 20 nt, Artificial Sequence
  Synthetic
caccugugguaucacuccaa

SEQ ID NO: 3022 - RNA, 20 nt, Artificial Sequence
  Synthetic
acugaauuauguuuauggca

SEQ ID NO: 3023 - RNA, 20 nt, Artificial Sequence
  Synthetic
ucuugggaagaacuggauca

SEQ ID NO: 3024 - RNA, 20 nt, Artificial Sequence
  Synthetic
uugagacuacugaacacuga

SEQ ID NO: 3025 - RNA, 20 nt, Artificial Sequence
  Synthetic
caccuauaagguaaaaguga

SEQ ID NO: 3026 - RNA, 20 nt, Artificial Sequence
  Synthetic
ucccaagaggcccaccuaua

SEQ ID NO: 3027 - RNA, 20 nt, Artificial Sequence
  Synthetic
acaauacugaauuauguuua

SEQ ID NO: 3028 - RNA, 20 nt, Artificial Sequence
  Synthetic
agccuuuggagugauaccac

SEQ ID NO: 3029 - RNA, 20 nt, Artificial Sequence
  Synthetic
ugccuaugagaaaacugcac

SEQ ID NO: 3030 - RNA, 20 nt, Artificial Sequence
  Synthetic
cccaagacacaccaucgauc

SEQ ID NO: 3031 - RNA, 20 nt, Artificial Sequence
  Synthetic
cucuugggaagaacuggauc

SEQ ID NO: 3032 - RNA, 20 nt, Artificial Sequence
  Synthetic
uaauuuaguugccuuuuuuc

SEQ ID NO: 3033 - RNA, 20 nt, Artificial Sequence
  Synthetic
cugauccaguucuucccaag

SEQ ID NO: 3034 - RNA, 20 nt, Artificial Sequence
  Synthetic
caucacuuuuaccuuauagg

SEQ ID NO: 3035 - RNA, 20 nt, Artificial Sequence
  Synthetic
uaaguccuuuugcucaccug

SEQ ID NO: 3036 - RNA, 20 nt, Artificial Sequence
  Synthetic
cuccagugcaguuuucucau

SEQ ID NO: 3037 - RNA, 20 nt, Artificial Sequence
  Synthetic
accuauaagguaaaagugau

SEQ ID NO: 3038 - RNA, 20 nt, Artificial Sequence
  Synthetic
ucccaucacuuuuaccuuau

SEQ ID NO: 3039 - RNA, 20 nt, Artificial Sequence
  Synthetic
uaccuuauaggugggccucu

SEQ ID NO: 3040 - RNA, 20 nt, Artificial Sequence
  Synthetic
uccagaucgauggugugucu

SEQ ID NO: 3041 - RNA, 20 nt, Artificial Sequence
  Synthetic
aucacuuuuaccuuauaggu

SEQ ID NO: 3042 - RNA, 20 nt, Artificial Sequence
  Synthetic
ccagaucgauggugugucuu

SEQ ID NO: 3043 - RNA, 17 nt, Artificial Sequence
  Synthetic
ggacuuagccagaaaaa

SEQ ID NO: 3044 - RNA, 20 nt, Artificial Sequence
  Synthetic
ggaucacuucugugacauau

SEQ ID NO: 3045 - RNA, 17 nt, Artificial Sequence
  Synthetic
ugggaagaacuggauca

SEQ ID NO: 3046 - RNA, 17 nt, Artificial Sequence
  Synthetic
auacugaauuauguuua

SEQ ID NO: 3047 - RNA, 17 nt, Artificial Sequence
  Synthetic
uuuaguugccuuuuuuc

SEQ ID NO: 3048 - RNA, 17 nt, Artificial Sequence
  Synthetic
cagugaaggaaagccuu

SEQ ID NO: 3049 - RNA, 20 nt, Artificial Sequence
  Synthetic
ugauaccacaggugagcaaa

SEQ ID NO: 3050 - RNA, 20 nt, Artificial Sequence
  Synthetic
caauaacuuugcaacaguga

SEQ ID NO: 3051 - RNA, 20 nt, Artificial Sequence
  Synthetic
caacagugaaggaaagccuu

SEQ ID NO: 3052 - RNA, 20 nt, Artificial Sequence
  Synthetic
accuuauaggugggccucuu

SEQ ID NO: 3053 - RNA, 23 nt, Artificial Sequence
  Synthetic
gcccaccuauaagguaaaaguga

SEQ ID NO: 3054 - RNA, 24 nt, Artificial Sequence
  Synthetic
ggcccaccuauaagguaaaaguga

SEQ ID NO: 3055 - RNA, 19 nt, Artificial Sequence
  Synthetic
gcauaacaaauauauuuug

SEQ ID NO: 3056 - RNA, 23 nt, Artificial Sequence
  Synthetic
gaaucccaagacacaccaucgau

SEQ ID NO: 3057 - RNA, 19 nt, Artificial Sequence
  Synthetic
gugggccucuugggaagaa

SEQ ID NO: 3058 - RNA, 20 nt, Artificial Sequence
  Synthetic
ggugggccucuugggaagaa

SEQ ID NO: 3059 - RNA, 18 nt, Artificial Sequence
  Synthetic
ggaagaacuggaucaggg

SEQ ID NO: 3060 - RNA, 19 nt, Artificial Sequence
  Synthetic
gggaagaacuggaucaggg

SEQ ID NO: 3061 - RNA, 24 nt, Artificial Sequence
  Synthetic
gaaauccagaucgauggugugucu

SEQ ID NO: 3062 - RNA, 18 nt, Artificial Sequence
  Synthetic
ccuauaagguaaaaguga

SEQ ID NO: 3063 - RNA, 19 nt, Artificial Sequence
  Synthetic
accuauaagguaaaaguga

SEQ ID NO: 3064 - RNA, 21 nt, Artificial Sequence
  Synthetic
ccaccuauaagguaaaaguga

SEQ ID NO: 3065 - RNA, 22 nt, Artificial Sequence
  Synthetic
cccaccuauaagguaaaaguga

SEQ ID NO: 3066 - RNA, 21 nt, Artificial Sequence
  Synthetic
uugcagaguaauaugaauuuc

SEQ ID NO: 3067 - RNA, 22 nt, Artificial Sequence
  Synthetic
uuugcagaguaauaugaauuuc

SEQ ID NO: 3068 - RNA, 23 nt, Artificial Sequence
  Synthetic
uuuugcagaguaauaugaauuuc

SEQ ID NO: 3069 - RNA, 24 nt, Artificial Sequence
  Synthetic
auuuugcagaguaauaugaauuuc

SEQ ID NO: 3070 - RNA, 18 nt, Artificial Sequence
  Synthetic
cauaacaaauauauuuug

SEQ ID NO: 3071 - RNA, 20 nt, Artificial Sequence
  Synthetic
ugcauaacaaauauauuuug

SEQ ID NO: 3072 - RNA, 18 nt, Artificial Sequence
  Synthetic
uauauuuugcagaguaau

SEQ ID NO: 3073 - RNA, 19 nt, Artificial Sequence
  Synthetic
auauauuuugcagaguaau

SEQ ID NO: 3074 - RNA, 20 nt, Artificial Sequence
  Synthetic
aauauauuuugcagaguaau

SEQ ID NO: 3075 - RNA, 18 nt, Artificial Sequence
  Synthetic
ccaagacacaccaucgau

SEQ ID NO: 3076 - RNA, 19 nt, Artificial Sequence
  Synthetic
cccaagacacaccaucgau

SEQ ID NO: 3077 - RNA, 20 nt, Artificial Sequence
  Synthetic
ucccaagacacaccaucgau

SEQ ID NO: 3078 - RNA, 21 nt, Artificial Sequence
  Synthetic
aucccaagacacaccaucgau

SEQ ID NO: 3079 - RNA, 22 nt, Artificial Sequence
  Synthetic
aaucccaagacacaccaucgau

SEQ ID NO: 3080 - RNA, 24 nt, Artificial Sequence
  Synthetic
ugaaucccaagacacaccaucgau

SEQ ID NO: 3081 - RNA, 18 nt, Artificial Sequence
  Synthetic
ugggccucuugggaagaa

SEQ ID NO: 3082 - RNA, 21 nt, Artificial Sequence
  Synthetic
aggugggccucuugggaagaa

SEQ ID NO: 3083 - RNA, 22 nt, Artificial Sequence
  Synthetic
uaggugggccucuugggaagaa

SEQ ID NO: 3084 - RNA, 23 nt, Artificial Sequence
  Synthetic
auaggugggccucuugggaagaa

SEQ ID NO: 3085 - RNA, 24 nt, Artificial Sequence
  Synthetic
uauaggugggccucuugggaagaa

SEQ ID NO: 3086 - RNA, 20 nt, Artificial Sequence
  Synthetic
ugggaagaacuggaucaggg

SEQ ID NO: 3087 - RNA, 21 nt, Artificial Sequence
  Synthetic
uugggaagaacuggaucaggg

SEQ ID NO: 3088 - RNA, 22 nt, Artificial Sequence
  Synthetic
cuugggaagaacuggaucaggg

SEQ ID NO: 3089 - RNA, 23 nt, Artificial Sequence
  Synthetic
ucuugggaagaacuggaucaggg

SEQ ID NO: 3090 - RNA, 24 nt, Artificial Sequence
  Synthetic
cucuugggaagaacuggaucaggg

SEQ ID NO: 3091 - RNA, 18 nt, Artificial Sequence
  Synthetic
cagaucgauggugugucu

SEQ ID NO: 3092 - RNA, 19 nt, Artificial Sequence
  Synthetic
ccagaucgauggugugucu

SEQ ID NO: 3093 - RNA, 21 nt, Artificial Sequence
  Synthetic
auccagaucgauggugugucu

SEQ ID NO: 3094 - RNA, 22 nt, Artificial Sequence
  Synthetic
aauccagaucgauggugugucu

SEQ ID NO: 3095 - RNA, 23 nt, Artificial Sequence
  Synthetic
aaauccagaucgauggugugucu

SEQ ID NO: 3096 - RNA, 19 nt, Artificial Sequence
  Synthetic
gcagaguaauaugaauuuc

SEQ ID NO: 3097 - RNA, 24 nt, Artificial Sequence
  Synthetic
gcaaugcauaacaaauauauuuug

SEQ ID NO: 3098 - RNA, 21 nt, Artificial Sequence
  Synthetic
gcaacagugaaggaaagccuu

SEQ ID NO: 3099 - RNA, 18 nt, Artificial Sequence
  Synthetic
uucacuguugcaaaguua

SEQ ID NO: 3100 - RNA, 19 nt, Artificial Sequence
  Synthetic
cuucacuguugcaaaguua

SEQ ID NO: 3101 - RNA, 20 nt, Artificial Sequence
  Synthetic
ccuucacuguugcaaaguua

SEQ ID NO: 3102 - RNA, 21 nt, Artificial Sequence
  Synthetic
uccuucacuguugcaaaguua

SEQ ID NO: 3103 - RNA, 22 nt, Artificial Sequence
  Synthetic
uuccuucacuguugcaaaguua

SEQ ID NO: 3104 - RNA, 23 nt, Artificial Sequence
  Synthetic
uuuccuucacuguugcaaaguua

SEQ ID NO: 3105 - RNA, 24 nt, Artificial Sequence
  Synthetic
cuuuccuucacuguugcaaaguua

SEQ ID NO: 3106 - RNA, 18 nt, Artificial Sequence
  Synthetic
cagaguaauaugaauuuc

SEQ ID NO: 3107 - RNA, 20 nt, Artificial Sequence
  Synthetic
ugcagaguaauaugaauuuc

SEQ ID NO: 3108 - RNA, 21 nt, Artificial Sequence
  Synthetic
augcauaacaaauauauuuug

SEQ ID NO: 3109 - RNA, 22 nt, Artificial Sequence
  Synthetic
aaugcauaacaaauauauuuug

SEQ ID NO: 3110 - RNA, 23 nt, Artificial Sequence
  Synthetic
caaugcauaacaaauauauuuug

SEQ ID NO: 3111 - RNA, 21 nt, Artificial Sequence
  Synthetic
aaauauauuuugcagaguaau

SEQ ID NO: 3112 - RNA, 22 nt, Artificial Sequence
  Synthetic
caaauauauuuugcagaguaau

SEQ ID NO: 3113 - RNA, 23 nt, Artificial Sequence
  Synthetic
acaaauauauuuugcagaguaau

SEQ ID NO: 3114 - RNA, 24 nt, Artificial Sequence
  Synthetic
aacaaauauauuuugcagaguaau

SEQ ID NO: 3115 - RNA, 18 nt, Artificial Sequence
  Synthetic
acagugaaggaaagccuu

SEQ ID NO: 3116 - RNA, 19 nt, Artificial Sequence
  Synthetic
aacagugaaggaaagccuu

SEQ ID NO: 3117 - RNA, 22 nt, Artificial Sequence
  Synthetic
ugcaacagugaaggaaagccuu

SEQ ID NO: 3118 - RNA, 23 nt, Artificial Sequence
  Synthetic
uugcaacagugaaggaaagccuu

SEQ ID NO: 3119 - RNA, 24 nt, Artificial Sequence
  Synthetic
uuugcaacagugaaggaaagccuu

SEQ ID NO: 3120 - RNA, 18 nt, Artificial Sequence
  Synthetic
gccuaugagaaaacugca

SEQ ID NO: 3121 - RNA, 19 nt, Artificial Sequence
  Synthetic
ugccuaugagaaaacugca

SEQ ID NO: 3122 - RNA, 20 nt, Artificial Sequence
  Synthetic
cugccuaugagaaaacugca

SEQ ID NO: 3123 - RNA, 21 nt, Artificial Sequence
  Synthetic
ucugccuaugagaaaacugca

SEQ ID NO: 3124 - RNA, 22 nt, Artificial Sequence
  Synthetic
uucugccuaugagaaaacugca

SEQ ID NO: 3125 - RNA, 23 nt, Artificial Sequence
  Synthetic
uuucugccuaugagaaaacugca

SEQ ID NO: 3126 - RNA, 24 nt, Artificial Sequence
  Synthetic
uuuucugccuaugagaaaacugca

SEQ ID NO: 3127 - RNA, 18 nt, Artificial Sequence
  Synthetic
ccuaugagaaaacugcac

SEQ ID NO: 3128 - RNA, 19 nt, Artificial Sequence
  Synthetic
gccuaugagaaaacugcac

SEQ ID NO: 3129 - RNA, 21 nt, Artificial Sequence
  Synthetic
cugccuaugagaaaacugcac

SEQ ID NO: 3130 - RNA, 22 nt, Artificial Sequence
  Synthetic
ucugccuaugagaaaacugcac

SEQ ID NO: 3131 - RNA, 23 nt, Artificial Sequence
  Synthetic
uucugccuaugagaaaacugcac

SEQ ID NO: 3132 - RNA, 24 nt, Artificial Sequence
  Synthetic
uuucugccuaugagaaaacugcac

SEQ ID NO: 3133 - RNA, 18 nt, Artificial Sequence
  Synthetic
ccugauccaguucuuccc

SEQ ID NO: 3134 - RNA, 19 nt, Artificial Sequence
  Synthetic
cccugauccaguucuuccc

SEQ ID NO: 3135 - RNA, 20 nt, Artificial Sequence
  Synthetic
ucccugauccaguucuuccc

SEQ ID NO: 3136 - RNA, 21 nt, Artificial Sequence
  Synthetic
uucccugauccaguucuuccc

SEQ ID NO: 3137 - RNA, 22 nt, Artificial Sequence
  Synthetic
cuucccugauccaguucuuccc

SEQ ID NO: 3138 - RNA, 23 nt, Artificial Sequence
  Synthetic
ucuucccugauccaguucuuccc

SEQ ID NO: 3139 - RNA, 24 nt, Artificial Sequence
  Synthetic
cucuucccugauccaguucuuccc

SEQ ID NO: 3140 - RNA, 18 nt, Artificial Sequence
  Synthetic
uaugagaaaacugcacug

SEQ ID NO: 3141 - RNA, 19 nt, Artificial Sequence
  Synthetic
cuaugagaaaacugcacug

SEQ ID NO: 3142 - RNA, 20 nt, Artificial Sequence
  Synthetic
ccuaugagaaaacugcacug

SEQ ID NO: 3143 - RNA, 21 nt, Artificial Sequence
  Synthetic
gccuaugagaaaacugcacug

SEQ ID NO: 3144 - RNA, 22 nt, Artificial Sequence
  Synthetic
ugccuaugagaaaacugcacug

SEQ ID NO: 3145 - RNA, 23 nt, Artificial Sequence
  Synthetic
cugccuaugagaaaacugcacug

SEQ ID NO: 3146 - RNA, 24 nt, Artificial Sequence
  Synthetic
ucugccuaugagaaaacugcacug

SEQ ID NO: 3147 - RNA, 18 nt, Artificial Sequence
  Synthetic
accuauaagguaaaagug

SEQ ID NO: 3148 - RNA, 19 nt, Artificial Sequence
  Synthetic
caccuauaagguaaaagug

SEQ ID NO: 3149 - RNA, 20 nt, Artificial Sequence
  Synthetic
ccaccuauaagguaaaagug

SEQ ID NO: 3150 - RNA, 21 nt, Artificial Sequence
  Synthetic
cccaccuauaagguaaaagug

SEQ ID NO: 3151 - RNA, 22 nt, Artificial Sequence
  Synthetic
gcccaccuauaagguaaaagug

SEQ ID NO: 3152 - RNA, 23 nt, Artificial Sequence
  Synthetic
ggcccaccuauaagguaaaagug

SEQ ID NO: 3153 - RNA, 24 nt, Artificial Sequence
  Synthetic
aggcccaccuauaagguaaaagug

SEQ ID NO: 3154 - RNA, 18 nt, Artificial Sequence
  Synthetic
gacaucuuuucugccuau

SEQ ID NO: 3155 - RNA, 19 nt, Artificial Sequence
  Synthetic
agacaucuuuucugccuau

SEQ ID NO: 3156 - RNA, 20 nt, Artificial Sequence
  Synthetic
gagacaucuuuucugccuau

SEQ ID NO: 3157 - RNA, 21 nt, Artificial Sequence
  Synthetic
agagacaucuuuucugccuau

SEQ ID NO: 3158 - RNA, 22 nt, Artificial Sequence
  Synthetic
uagagacaucuuuucugccuau

SEQ ID NO: 3159 - RNA, 23 nt, Artificial Sequence
  Synthetic
uuagagacaucuuuucugccuau

SEQ ID NO: 3160 - RNA, 24 nt, Artificial Sequence
  Synthetic
uuuagagacaucuuuucugccuau

SEQ ID NO: 3161 - RNA, 18 nt, Artificial Sequence
  Synthetic
gagacaucuuuucugccu

SEQ ID NO: 3162 - RNA, 19 nt, Artificial Sequence
  Synthetic
agagacaucuuuucugccu

SEQ ID NO: 3163 - RNA, 20 nt, Artificial Sequence
  Synthetic
uagagacaucuuuucugccu

SEQ ID NO: 3164 - RNA, 21 nt, Artificial Sequence
  Synthetic
uuagagacaucuuuucugccu

SEQ ID NO: 3165 - RNA, 22 nt, Artificial Sequence
  Synthetic
uuuagagacaucuuuucugccu

SEQ ID NO: 3166 - RNA, 23 nt, Artificial Sequence
  Synthetic
uuuuagagacaucuuuucugccu

SEQ ID NO: 3167 - RNA, 24 nt, Artificial Sequence
  Synthetic
cuuuuagagacaucuuuucugccu

SEQ ID NO: 3168 - RNA, 18 nt, Artificial Sequence
  Synthetic
gauaccacaggugagcaa

SEQ ID NO: 3169 - RNA, 19 nt, Artificial Sequence
  Synthetic
ugauaccacaggugagcaa

SEQ ID NO: 3170 - RNA, 20 nt, Artificial Sequence
  Synthetic
gugauaccacaggugagcaa

SEQ ID NO: 3171 - RNA, 21 nt, Artificial Sequence
  Synthetic
agugauaccacaggugagcaa

SEQ ID NO: 3172 - RNA, 22 nt, Artificial Sequence
  Synthetic
gagugauaccacaggugagcaa

SEQ ID NO: 3173 - RNA, 23 nt, Artificial Sequence
  Synthetic
ggagugauaccacaggugagcaa

SEQ ID NO: 3174 - RNA, 24 nt, Artificial Sequence
  Synthetic
uggagugauaccacaggugagcaa

SEQ ID NO: 3175 - RNA, 18 nt, Artificial Sequence
  Synthetic
uucaauaacuuugcaaca

SEQ ID NO: 3176 - RNA, 19 nt, Artificial Sequence
  Synthetic
auucaauaacuuugcaaca

SEQ ID NO: 3177 - RNA, 20 nt, Artificial Sequence
  Synthetic
gauucaauaacuuugcaaca

SEQ ID NO: 3178 - RNA, 21 nt, Artificial Sequence
  Synthetic
ggauucaauaacuuugcaaca

SEQ ID NO: 3179 - RNA, 22 nt, Artificial Sequence
  Synthetic
gggauucaauaacuuugcaaca

SEQ ID NO: 3180 - RNA, 23 nt, Artificial Sequence
  Synthetic
ugggauucaauaacuuugcaaca

SEQ ID NO: 3181 - RNA, 24 nt, Artificial Sequence
  Synthetic
uugggauucaauaacuuugcaaca

SEQ ID NO: 3182 - RNA, 18 nt, Artificial Sequence
  Synthetic
uuuugagacuacugaaca

SEQ ID NO: 3183 - RNA, 19 nt, Artificial Sequence
  Synthetic
uuuuugagacuacugaaca

SEQ ID NO: 3184 - RNA, 20 nt, Artificial Sequence
  Synthetic
uuuuuugagacuacugaaca

SEQ ID NO: 3185 - RNA, 21 nt, Artificial Sequence
  Synthetic
cuuuuuugagacuacugaaca

SEQ ID NO: 3186 - RNA, 22 nt, Artificial Sequence
  Synthetic
gcuuuuuugagacuacugaaca

SEQ ID NO: 3187 - RNA, 23 nt, Artificial Sequence
  Synthetic
agcuuuuuugagacuacugaaca

SEQ ID NO: 3188 - RNA, 24 nt, Artificial Sequence
  Synthetic
cagcuuuuuugagacuacugaaca

SEQ ID NO: 3189 - RNA, 18 nt, Artificial Sequence
  Synthetic
uugggaagaacuggauca

SEQ ID NO: 3190 - RNA, 19 nt, Artificial Sequence
  Synthetic
cuugggaagaacuggauca

SEQ ID NO: 3191 - RNA, 21 nt, Artificial Sequence
  Synthetic
cucuugggaagaacuggauca

SEQ ID NO: 3192 - RNA, 22 nt, Artificial Sequence
  Synthetic
ccucuugggaagaacuggauca

SEQ ID NO: 3193 - RNA, 23 nt, Artificial Sequence
  Synthetic
gccucuugggaagaacuggauca

SEQ ID NO: 3194 - RNA, 24 nt, Artificial Sequence
  Synthetic
ggccucuugggaagaacuggauca

SEQ ID NO: 3195 - RNA, 18 nt, Artificial Sequence
  Synthetic
caugguaccuauauguca

SEQ ID NO: 3196 - RNA, 19 nt, Artificial Sequence
  Synthetic
gcaugguaccuauauguca

SEQ ID NO: 3197 - RNA, 20 nt, Artificial Sequence
  Synthetic
ggcaugguaccuauauguca

SEQ ID NO: 3198 - RNA, 21 nt, Artificial Sequence
  Synthetic
uggcaugguaccuauauguca

SEQ ID NO: 3199 - RNA, 22 nt, Artificial Sequence
  Synthetic
auggcaugguaccuauauguca

SEQ ID NO: 3200 - RNA, 23 nt, Artificial Sequence
  Synthetic
uauggcaugguaccuauauguca

SEQ ID NO: 3201 - RNA, 24 nt, Artificial Sequence
  Synthetic
uuauggcaugguaccuauauguca

SEQ ID NO: 3202 - RNA, 18 nt, Artificial Sequence
  Synthetic
gagacuacugaacacuga

SEQ ID NO: 3203 - RNA, 19 nt, Artificial Sequence
  Synthetic
ugagacuacugaacacuga

SEQ ID NO: 3204 - RNA, 21 nt, Artificial Sequence
  Synthetic
uuugagacuacugaacacuga

SEQ ID NO: 3205 - RNA, 22 nt, Artificial Sequence
  Synthetic
uuuugagacuacugaacacuga

SEQ ID NO: 3206 - RNA, 23 nt, Artificial Sequence
  Synthetic
uuuuugagacuacugaacacuga

SEQ ID NO: 3207 - RNA, 24 nt, Artificial Sequence
  Synthetic
uuuuuugagacuacugaacacuga

SEQ ID NO: 3208 - RNA, 18 nt, Artificial Sequence
  Synthetic
auaacuuugcaacaguga

SEQ ID NO: 3209 - RNA, 19 nt, Artificial Sequence
  Synthetic
aauaacuuugcaacaguga

SEQ ID NO: 3210 - RNA, 21 nt, Artificial Sequence
  Synthetic
ucaauaacuuugcaacaguga

SEQ ID NO: 3211 - RNA, 22 nt, Artificial Sequence
  Synthetic
uucaauaacuuugcaacaguga

SEQ ID NO: 3212 - RNA, 23 nt, Artificial Sequence
  Synthetic
auucaauaacuuugcaacaguga

SEQ ID NO: 3213 - RNA, 24 nt, Artificial Sequence
  Synthetic
gauucaauaacuuugcaacaguga

SEQ ID NO: 3214 - RNA, 18 nt, Artificial Sequence
  Synthetic
ucagcuuuuuugagacua

SEQ ID NO: 3215 - RNA, 19 nt, Artificial Sequence
  Synthetic
aucagcuuuuuugagacua

SEQ ID NO: 3216 - RNA, 20 nt, Artificial Sequence
  Synthetic
uaucagcuuuuuugagacua

SEQ ID NO: 3217 - RNA, 21 nt, Artificial Sequence
  Synthetic
uuaucagcuuuuuugagacua

SEQ ID NO: 3218 - RNA, 22 nt, Artificial Sequence
  Synthetic
guuaucagcuuuuuugagacua

SEQ ID NO: 3219 - RNA, 23 nt, Artificial Sequence
  Synthetic
uguuaucagcuuuuuugagacua

SEQ ID NO: 3220 - RNA, 24 nt, Artificial Sequence
  Synthetic
uuguuaucagcuuuuuugagacua

SEQ ID NO: 3221 - RNA, 18 nt, Artificial Sequence
  Synthetic
ugagcaaaaggacuuagc

SEQ ID NO: 3222 - RNA, 19 nt, Artificial Sequence
  Synthetic
gugagcaaaaggacuuagc

SEQ ID NO: 3223 - RNA, 20 nt, Artificial Sequence
  Synthetic
ggugagcaaaaggacuuagc

SEQ ID NO: 3224 - RNA, 21 nt, Artificial Sequence
  Synthetic
aggugagcaaaaggacuuagc

SEQ ID NO: 3225 - RNA, 22 nt, Artificial Sequence
  Synthetic
caggugagcaaaaggacuuagc

SEQ ID NO: 3226 - RNA, 23 nt, Artificial Sequence
  Synthetic
acaggugagcaaaaggacuuagc

SEQ ID NO: 3227 - RNA, 24 nt, Artificial Sequence
  Synthetic
cacaggugagcaaaaggacuuagc

SEQ ID NO: 3228 - RNA, 18 nt, Artificial Sequence
  Synthetic
cuugggaagaacuggauc

SEQ ID NO: 3229 - RNA, 19 nt, Artificial Sequence
  Synthetic
ucuugggaagaacuggauc

SEQ ID NO: 3230 - RNA, 21 nt, Artificial Sequence
  Synthetic
ccucuugggaagaacuggauc

SEQ ID NO: 3231 - RNA, 22 nt, Artificial Sequence
  Synthetic
gccucuugggaagaacuggauc

SEQ ID NO: 3232 - RNA, 23 nt, Artificial Sequence
  Synthetic
ggccucuugggaagaacuggauc

SEQ ID NO: 3233 - RNA, 24 nt, Artificial Sequence
  Synthetic
gggccucuugggaagaacuggauc

SEQ ID NO: 3234 - RNA, 18 nt, Artificial Sequence
  Synthetic
uauuugauacuuguacuc

SEQ ID NO: 3235 - RNA, 19 nt, Artificial Sequence
  Synthetic
cuauuugauacuuguacuc

SEQ ID NO: 3236 - RNA, 20 nt, Artificial Sequence
  Synthetic
gcuauuugauacuuguacuc

SEQ ID NO: 3237 - RNA, 21 nt, Artificial Sequence
  Synthetic
ugcuauuugauacuuguacuc

SEQ ID NO: 3238 - RNA, 22 nt, Artificial Sequence
  Synthetic
cugcuauuugauacuuguacuc

SEQ ID NO: 3239 - RNA, 23 nt, Artificial Sequence
  Synthetic
acugcuauuugauacuuguacuc

SEQ ID NO: 3240 - RNA, 24 nt, Artificial Sequence
  Synthetic
uacugcuauuugauacuuguacuc

SEQ ID NO: 3241 - RNA, 18 nt, Artificial Sequence
  Synthetic
accuuauaggugggccuc

SEQ ID NO: 3242 - RNA, 19 nt, Artificial Sequence
  Synthetic
uaccuuauaggugggccuc

SEQ ID NO: 3243 - RNA, 20 nt, Artificial Sequence
  Synthetic
uuaccuuauaggugggccuc

SEQ ID NO: 3244 - RNA, 21 nt, Artificial Sequence
  Synthetic
uuuaccuuauaggugggccuc

SEQ ID NO: 3245 - RNA, 22 nt, Artificial Sequence
  Synthetic
uuuuaccuuauaggugggccuc

SEQ ID NO: 3246 - RNA, 23 nt, Artificial Sequence
  Synthetic
cuuuuaccuuauaggugggccuc

SEQ ID NO: 3247 - RNA, 24 nt, Artificial Sequence
  Synthetic
acuuuuaccuuauaggugggccuc

SEQ ID NO: 3248 - RNA, 18 nt, Artificial Sequence
  Synthetic
ccagaucgaugguguguc

SEQ ID NO: 3249 - RNA, 19 nt, Artificial Sequence
  Synthetic
uccagaucgaugguguguc

SEQ ID NO: 3250 - RNA, 20 nt, Artificial Sequence
  Synthetic
auccagaucgaugguguguc

SEQ ID NO: 3251 - RNA, 21 nt, Artificial Sequence
  Synthetic
aauccagaucgaugguguguc

SEQ ID NO: 3252 - RNA, 22 nt, Artificial Sequence
  Synthetic
aaauccagaucgaugguguguc

SEQ ID NO: 3253 - RNA, 23 nt, Artificial Sequence
  Synthetic
gaaauccagaucgaugguguguc

SEQ ID NO: 3254 - RNA, 24 nt, Artificial Sequence
  Synthetic
agaaauccagaucgaugguguguc

SEQ ID NO: 3255 - RNA, 18 nt, Artificial Sequence
  Synthetic
gacuacugaacacugaag

SEQ ID NO: 3256 - RNA, 19 nt, Artificial Sequence
  Synthetic
agacuacugaacacugaag

SEQ ID NO: 3257 - RNA, 20 nt, Artificial Sequence
  Synthetic
gagacuacugaacacugaag

SEQ ID NO: 3258 - RNA, 21 nt, Artificial Sequence
  Synthetic
ugagacuacugaacacugaag

SEQ ID NO: 3259 - RNA, 22 nt, Artificial Sequence
  Synthetic
uugagacuacugaacacugaag

SEQ ID NO: 3260 - RNA, 23 nt, Artificial Sequence
  Synthetic
uuugagacuacugaacacugaag

SEQ ID NO: 3261 - RNA, 24 nt, Artificial Sequence
  Synthetic
uuuugagacuacugaacacugaag

SEQ ID NO: 3262 - RNA, 18 nt, Artificial Sequence
  Synthetic
uuuggagugauaccacag

SEQ ID NO: 3263 - RNA, 19 nt, Artificial Sequence
  Synthetic
cuuuggagugauaccacag

SEQ ID NO: 3264 - RNA, 20 nt, Artificial Sequence
  Synthetic
ccuuuggagugauaccacag

SEQ ID NO: 3265 - RNA, 21 nt, Artificial Sequence
  Synthetic
gccuuuggagugauaccacag

SEQ ID NO: 3266 - RNA, 22 nt, Artificial Sequence
  Synthetic
agccuuuggagugauaccacag

SEQ ID NO: 3267 - RNA, 23 nt, Artificial Sequence
  Synthetic
aagccuuuggagugauaccacag

SEQ ID NO: 3268 - RNA, 24 nt, Artificial Sequence
  Synthetic
aaagccuuuggagugauaccacag

SEQ ID NO: 3269 - RNA, 18 nt, Artificial Sequence
  Synthetic
aucacuuuuaccuuauag

SEQ ID NO: 3270 - RNA, 19 nt, Artificial Sequence
  Synthetic
caucacuuuuaccuuauag

SEQ ID NO: 3271 - RNA, 20 nt, Artificial Sequence
  Synthetic
ccaucacuuuuaccuuauag

SEQ ID NO: 3272 - RNA, 21 nt, Artificial Sequence
  Synthetic
cccaucacuuuuaccuuauag

SEQ ID NO: 3273 - RNA, 22 nt, Artificial Sequence
  Synthetic
ucccaucacuuuuaccuuauag

SEQ ID NO: 3274 - RNA, 23 nt, Artificial Sequence
  Synthetic
aucccaucacuuuuaccuuauag

SEQ ID NO: 3275 - RNA, 24 nt, Artificial Sequence
  Synthetic
gaucccaucacuuuuaccuuauag

SEQ ID NO: 3276 - RNA, 18 nt, Artificial Sequence
  Synthetic
gugcaguuuucucauagg

SEQ ID NO: 3277 - RNA, 19 nt, Artificial Sequence
  Synthetic
agugcaguuuucucauagg

SEQ ID NO: 3278 - RNA, 20 nt, Artificial Sequence
  Synthetic
cagugcaguuuucucauagg

SEQ ID NO: 3279 - RNA, 21 nt, Artificial Sequence
  Synthetic
ccagugcaguuuucucauagg

SEQ ID NO: 3280 - RNA, 22 nt, Artificial Sequence
  Synthetic
uccagugcaguuuucucauagg

SEQ ID NO: 3281 - RNA, 23 nt, Artificial Sequence
  Synthetic
cuccagugcaguuuucucauagg

SEQ ID NO: 3282 - RNA, 24 nt, Artificial Sequence
  Synthetic
ucuccagugcaguuuucucauagg

SEQ ID NO: 3283 - RNA, 18 nt, Artificial Sequence
  Synthetic
auaggugggccucuuggg

SEQ ID NO: 3284 - RNA, 19 nt, Artificial Sequence
  Synthetic
uauaggugggccucuuggg

SEQ ID NO: 3285 - RNA, 20 nt, Artificial Sequence
  Synthetic
uuauaggugggccucuuggg

SEQ ID NO: 3286 - RNA, 21 nt, Artificial Sequence
  Synthetic
cuuauaggugggccucuuggg

SEQ ID NO: 3287 - RNA, 22 nt, Artificial Sequence
  Synthetic
ccuuauaggugggccucuuggg

SEQ ID NO: 3288 - RNA, 23 nt, Artificial Sequence
  Synthetic
accuuauaggugggccucuuggg

SEQ ID NO: 3289 - RNA, 24 nt, Artificial Sequence
  Synthetic
uaccuuauaggugggccucuuggg

SEQ ID NO: 3290 - RNA, 18 nt, Artificial Sequence
  Synthetic
ugagacuacugaacacug

SEQ ID NO: 3291 - RNA, 19 nt, Artificial Sequence
  Synthetic
uugagacuacugaacacug

SEQ ID NO: 3292 - RNA, 20 nt, Artificial Sequence
  Synthetic
uuugagacuacugaacacug

SEQ ID NO: 3293 - RNA, 21 nt, Artificial Sequence
  Synthetic
uuuugagacuacugaacacug

SEQ ID NO: 3294 - RNA, 22 nt, Artificial Sequence
  Synthetic
uuuuugagacuacugaacacug

SEQ ID NO: 3295 - RNA, 23 nt, Artificial Sequence
  Synthetic
uuuuuugagacuacugaacacug

SEQ ID NO: 3296 - RNA, 24 nt, Artificial Sequence
  Synthetic
cuuuuuugagacuacugaacacug

SEQ ID NO: 3297 - RNA, 18 nt, Artificial Sequence
  Synthetic
aauaacuuugcaacagug

SEQ ID NO: 3298 - RNA, 19 nt, Artificial Sequence
  Synthetic
caauaacuuugcaacagug

SEQ ID NO: 3299 - RNA, 20 nt, Artificial Sequence
  Synthetic
ucaauaacuuugcaacagug

SEQ ID NO: 3300 - RNA, 21 nt, Artificial Sequence
  Synthetic
uucaauaacuuugcaacagug

SEQ ID NO: 3301 - RNA, 22 nt, Artificial Sequence
  Synthetic
auucaauaacuuugcaacagug

SEQ ID NO: 3302 - RNA, 23 nt, Artificial Sequence
  Synthetic
gauucaauaacuuugcaacagug

SEQ ID NO: 3303 - RNA, 24 nt, Artificial Sequence
  Synthetic
ggauucaauaacuuugcaacagug

SEQ ID NO: 3304 - RNA, 18 nt, Artificial Sequence
  Synthetic
ucuugggaagaacuggau

SEQ ID NO: 3305 - RNA, 19 nt, Artificial Sequence
  Synthetic
cucuugggaagaacuggau

SEQ ID NO: 3306 - RNA, 20 nt, Artificial Sequence
  Synthetic
ccucuugggaagaacuggau

SEQ ID NO: 3307 - RNA, 21 nt, Artificial Sequence
  Synthetic
gccucuugggaagaacuggau

SEQ ID NO: 3308 - RNA, 22 nt, Artificial Sequence
  Synthetic
ggccucuugggaagaacuggau

SEQ ID NO: 3309 - RNA, 23 nt, Artificial Sequence
  Synthetic
gggccucuugggaagaacuggau

SEQ ID NO: 3310 - RNA, 24 nt, Artificial Sequence
  Synthetic
ugggccucuugggaagaacuggau

SEQ ID NO: 3311 - RNA, 18 nt, Artificial Sequence
  Synthetic
aacagugaaggaaagccu

SEQ ID NO: 3312 - RNA, 19 nt, Artificial Sequence
  Synthetic
caacagugaaggaaagccu

SEQ ID NO: 3313 - RNA, 20 nt, Artificial Sequence
  Synthetic
gcaacagugaaggaaagccu

SEQ ID NO: 3314 - RNA, 21 nt, Artificial Sequence
  Synthetic
ugcaacagugaaggaaagccu

SEQ ID NO: 3315 - RNA, 22 nt, Artificial Sequence
  Synthetic
uugcaacagugaaggaaagccu

SEQ ID NO: 3316 - RNA, 23 nt, Artificial Sequence
  Synthetic
uuugcaacagugaaggaaagccu

SEQ ID NO: 3317 - RNA, 24 nt, Artificial Sequence
  Synthetic
cuuugcaacagugaaggaaagccu

SEQ ID NO: 3318 - RNA, 18 nt, Artificial Sequence
  Synthetic
ccuuauaggugggccucu

SEQ ID NO: 3319 - RNA, 19 nt, Artificial Sequence
  Synthetic
accuuauaggugggccucu

SEQ ID NO: 3320 - RNA, 21 nt, Artificial Sequence
  Synthetic
uuaccuuauaggugggccucu

SEQ ID NO: 3321 - RNA, 22 nt, Artificial Sequence
  Synthetic
uuuaccuuauaggugggccucu

SEQ ID NO: 3322 - RNA, 23 nt, Artificial Sequence
  Synthetic
uuuuaccuuauaggugggccucu

SEQ ID NO: 3323 - RNA, 24 nt, Artificial Sequence
  Synthetic
cuuuuaccuuauaggugggccucu

SEQ ID NO: 3324 - RNA, 18 nt, Artificial Sequence
  Synthetic
cuuauaggugggccucuu

SEQ ID NO: 3325 - RNA, 19 nt, Artificial Sequence
  Synthetic
ccuuauaggugggccucuu

SEQ ID NO: 3326 - RNA, 21 nt, Artificial Sequence
  Synthetic
uaccuuauaggugggccucuu

SEQ ID NO: 3327 - RNA, 22 nt, Artificial Sequence
  Synthetic
uuaccuuauaggugggccucuu

SEQ ID NO: 3328 - RNA, 23 nt, Artificial Sequence
  Synthetic
uuuaccuuauaggugggccucuu

SEQ ID NO: 3329 - RNA, 24 nt, Artificial Sequence
  Synthetic
uuuuaccuuauaggugggccucuu

SEQ ID NO: 3330 - RNA, 18 nt, Artificial Sequence
  Synthetic
acuuuguuaucagcuuuu

SEQ ID NO: 3331 - RNA, 19 nt, Artificial Sequence
  Synthetic
uacuuuguuaucagcuuuu

SEQ ID NO: 3332 - RNA, 20 nt, Artificial Sequence
  Synthetic
guacuuuguuaucagcuuuu

SEQ ID NO: 3333 - RNA, 21 nt, Artificial Sequence
  Synthetic
aguacuuuguuaucagcuuuu

SEQ ID NO: 3334 - RNA, 22 nt, Artificial Sequence
  Synthetic
gaguacuuuguuaucagcuuuu

SEQ ID NO: 3335 - RNA, 23 nt, Artificial Sequence
  Synthetic
agaguacuuuguuaucagcuuuu

SEQ ID NO: 3336 - RNA, 24 nt, Artificial Sequence
  Synthetic
aagaguacuuuguuaucagcuuuu

SEQ ID NO: 3337 - RNA, 17 nt, Artificial Sequence
  Synthetic
gggaagaguacuuuguu

SEQ ID NO: 3338 - RNA, 17 nt, Artificial Sequence
  Synthetic
ccaagacacaccaucga

SEQ ID NO: 3339 - RNA, 17 nt, Artificial Sequence
  Synthetic
accugugguaucacucc

SEQ ID NO: 3340 - RNA, 17 nt, Artificial Sequence
  Synthetic
cagaucgaugguguguc

SEQ ID NO: 3341 - RNA, 20 nt, Artificial Sequence
  Synthetic
aucccaagacacaccaucga

SEQ ID NO: 3342 - RNA, 20 nt, Artificial Sequence
  Synthetic
cucaccugugguaucacucc

SEQ ID NO: 3343 - RNA, 20 nt, Artificial Sequence
  Synthetic
ucagggaagaguacuuuguu

SEQ ID NO: 3344 - RNA, 17 nt, Artificial Sequence
  Synthetic
gaguaagacacccugaa

SEQ ID NO: 3345 - RNA, 17 nt, Artificial Sequence
  Synthetic
gauuucuggagaccaca

SEQ ID NO: 3346 - RNA, 17 nt, Artificial Sequence
  Synthetic
gguuuuagcuauuacuc

SEQ ID NO: 3347 - RNA, 17 nt, Artificial Sequence
  Synthetic
guaguugaaucauucag

SEQ ID NO: 3348 - RNA, 17 nt, Artificial Sequence
  Synthetic
gaacucaguuuuuaggu

SEQ ID NO: 3349 - RNA, 20 nt, Artificial Sequence
  Synthetic
gaaaggaaauguucuauuca

SEQ ID NO: 3350 - RNA, 20 nt, Artificial Sequence
  Synthetic
guuuuuagguugggaaagac

SEQ ID NO: 3351 - RNA, 20 nt, Artificial Sequence
  Synthetic
gcacauaauaauuaguuucc

SEQ ID NO: 3352 - RNA, 20 nt, Artificial Sequence
  Synthetic
gagaacucaguuuuuagguu

SEQ ID NO: 3353 - RNA, 20 nt, Artificial Sequence
  Synthetic
gaaaacacugacuuagauuu

SEQ ID NO: 3354 - RNA, 17 nt, Artificial Sequence
  Synthetic
ucugacacauuuuucaa

SEQ ID NO: 3355 - RNA, 17 nt, Artificial Sequence
  Synthetic
cuuugguuuagcuuuaa

SEQ ID NO: 3356 - RNA, 17 nt, Artificial Sequence
  Synthetic
ugaaauuuagauccaca

SEQ ID NO: 3357 - RNA, 17 nt, Artificial Sequence
  Synthetic
uugauccaacauucuca

SEQ ID NO: 3358 - RNA, 17 nt, Artificial Sequence
  Synthetic
aggaaauguucuauuca

SEQ ID NO: 3359 - RNA, 17 nt, Artificial Sequence
  Synthetic
uuuaauacugcaacaga

SEQ ID NO: 3360 - RNA, 17 nt, Artificial Sequence
  Synthetic
cagugaucuguugaaua

SEQ ID NO: 3361 - RNA, 17 nt, Artificial Sequence
  Synthetic
agcaguucaaugauaua

SEQ ID NO: 3362 - RNA, 17 nt, Artificial Sequence
  Synthetic
acacugacuuagauuua

SEQ ID NO: 3363 - RNA, 17 nt, Artificial Sequence
  Synthetic
cuucuuguuuauauaac

SEQ ID NO: 3364 - RNA, 17 nt, Artificial Sequence
  Synthetic
caaaggcaaggaaucac

SEQ ID NO: 3365 - RNA, 17 nt, Artificial Sequence
  Synthetic
uuuagguugggaaagac

SEQ ID NO: 3366 - RNA, 17 nt, Artificial Sequence
  Synthetic
uguauauaucacaguac

SEQ ID NO: 3367 - RNA, 17 nt, Artificial Sequence
  Synthetic
cagaucacugagaagcc

SEQ ID NO: 3368 - RNA, 17 nt, Artificial Sequence
  Synthetic
cauaauaauuaguuucc

SEQ ID NO: 3369 - RNA, 17 nt, Artificial Sequence
  Synthetic
ccgggauuuguuuuucc

SEQ ID NO: 3370 - RNA, 17 nt, Artificial Sequence
  Synthetic
uuauaucauugaacugc

SEQ ID NO: 3371 - RNA, 17 nt, Artificial Sequence
  Synthetic
cuuaaaagcuuauuugc

SEQ ID NO: 3372 - RNA, 17 nt, Artificial Sequence
  Synthetic
auucuucaugauaaauc

SEQ ID NO: 3373 - RNA, 17 nt, Artificial Sequence
  Synthetic
cuugauccaacauucuc

SEQ ID NO: 3374 - RNA, 17 nt, Artificial Sequence
  Synthetic
auagaacauuuccuuuc

SEQ ID NO: 3375 - RNA, 17 nt, Artificial Sequence
  Synthetic
acauaauaauuaguuuc

SEQ ID NO: 3376 - RNA, 17 nt, Artificial Sequence
  Synthetic
aauaucuauuuaaucag

SEQ ID NO: 3377 - RNA, 17 nt, Artificial Sequence
  Synthetic
caacauucucagggagg

SEQ ID NO: 3378 - RNA, 17 nt, Artificial Sequence
  Synthetic
auccaacauucucaggg

SEQ ID NO: 3379 - RNA, 17 nt, Artificial Sequence
  Synthetic
auacaauauaccauaug

SEQ ID NO: 3380 - RNA, 17 nt, Artificial Sequence
  Synthetic
caauuauaaucaccuug

SEQ ID NO: 3381 - RNA, 17 nt, Artificial Sequence
  Synthetic
ucuaucuugauaaacau

SEQ ID NO: 3382 - RNA, 17 nt, Artificial Sequence
  Synthetic
uaguugaaucauucagu

SEQ ID NO: 3383 - RNA, 17 nt, Artificial Sequence
  Synthetic
cuccucccugagaaugu

SEQ ID NO: 3384 - RNA, 17 nt, Artificial Sequence
  Synthetic
aaacaagaagacuuugu

SEQ ID NO: 3385 - RNA, 17 nt, Artificial Sequence
  Synthetic
aacucaguuuuuagguu

SEQ ID NO: 3386 - RNA, 17 nt, Artificial Sequence
  Synthetic
aacaagaagacuuuguu

SEQ ID NO: 3387 - RNA, 17 nt, Artificial Sequence
  Synthetic
aacacugacuuagauuu

SEQ ID NO: 3388 - RNA, 17 nt, Artificial Sequence
  Synthetic
uuuaaggucuauacuuu

SEQ ID NO: 3389 - RNA, 20 nt, Artificial Sequence
  Synthetic
caucuguugcaguauuaaaa

SEQ ID NO: 3390 - RNA, 20 nt, Artificial Sequence
  Synthetic
uauuuucaagagacuacaaa

SEQ ID NO: 3391 - RNA, 20 nt, Artificial Sequence
  Synthetic
auaucugacacauuuuucaa

SEQ ID NO: 3392 - RNA, 20 nt, Artificial Sequence
  Synthetic
aaucuuugguuuagcuuuaa

SEQ ID NO: 3393 - RNA, 20 nt, Artificial Sequence
  Synthetic
cuugauuucuggagaccaca

SEQ ID NO: 3394 - RNA, 20 nt, Artificial Sequence
  Synthetic
ugacacauuuuucaaaggca

SEQ ID NO: 3395 - RNA, 20 nt, Artificial Sequence
  Synthetic
aucuugauccaacauucuca

SEQ ID NO: 3396 - RNA, 20 nt, Artificial Sequence
  Synthetic
cauuuuaauacugcaacaga

SEQ ID NO: 3397 - RNA, 20 nt, Artificial Sequence
  Synthetic
ucucagugaucuguugaaua

SEQ ID NO: 3398 - RNA, 20 nt, Artificial Sequence
  Synthetic
cuuaaucaaaauuccucaua

SEQ ID NO: 3399 - RNA, 20 nt, Artificial Sequence
  Synthetic
accagcaguucaaugauaua

SEQ ID NO: 3400 - RNA, 20 nt, Artificial Sequence
  Synthetic
aaaacacugacuuagauuua

SEQ ID NO: 3401 - RNA, 20 nt, Artificial Sequence
  Synthetic
agauauuugauaguacuuua

SEQ ID NO: 3402 - RNA, 20 nt, Artificial Sequence
  Synthetic
uuucaaaggcaaggaaucac

SEQ ID NO: 3403 - RNA, 20 nt, Artificial Sequence
  Synthetic
uauuguauauaucacaguac

SEQ ID NO: 3404 - RNA, 20 nt, Artificial Sequence
  Synthetic
caacagaucacugagaagcc

SEQ ID NO: 3405 - RNA, 20 nt, Artificial Sequence
  Synthetic
aagccuggaaaaacaaaucc

SEQ ID NO: 3406 - RNA, 20 nt, Artificial Sequence
  Synthetic
uuuccgggauuuguuuuucc

SEQ ID NO: 3407 - RNA, 20 nt, Artificial Sequence
  Synthetic
uccuuauaucauugaacugc

SEQ ID NO: 3408 - RNA, 20 nt, Artificial Sequence
  Synthetic
ugucuuaaaagcuuauuugc

SEQ ID NO: 3409 - RNA, 20 nt, Artificial Sequence
  Synthetic
aaagguuuuagcuauuacuc

SEQ ID NO: 3410 - RNA, 20 nt, Artificial Sequence
  Synthetic
uaucuugauccaacauucuc

SEQ ID NO: 3411 - RNA, 20 nt, Artificial Sequence
  Synthetic
ugacuugucaucuugauuuc

SEQ ID NO: 3412 - RNA, 20 nt, Artificial Sequence
  Synthetic
ugaauagaacauuuccuuuc

SEQ ID NO: 3413 - RNA, 20 nt, Artificial Sequence
  Synthetic
uugggaaagacuggaugaag

SEQ ID NO: 3414 - RNA, 20 nt, Artificial Sequence
  Synthetic
ucaaauaucuauuuaaucag

SEQ ID NO: 3415 - RNA, 20 nt, Artificial Sequence
  Synthetic
aaaguaguugaaucauucag

SEQ ID NO: 3416 - RNA, 20 nt, Artificial Sequence
  Synthetic
auccaacauucucagggagg

SEQ ID NO: 3417 - RNA, 20 nt, Artificial Sequence
  Synthetic
uugauccaacauucucaggg

SEQ ID NO: 3418 - RNA, 20 nt, Artificial Sequence
  Synthetic
auucaauuauaaucaccuug

SEQ ID NO: 3419 - RNA, 20 nt, Artificial Sequence
  Synthetic
augucuuaaaagcuuauuug

SEQ ID NO: 3420 - RNA, 20 nt, Artificial Sequence
  Synthetic
uuuucuaucuugauaaacau

SEQ ID NO: 3421 - RNA, 20 nt, Artificial Sequence
  Synthetic
agagaacucaguuuuuaggu

SEQ ID NO: 3422 - RNA, 20 nt, Artificial Sequence
  Synthetic
caccuccucccugagaaugu

SEQ ID NO: 3423 - RNA, 20 nt, Artificial Sequence
  Synthetic
uauaaacaagaagacuuugu

SEQ ID NO: 3424 - RNA, 20 nt, Artificial Sequence
  Synthetic
aaguuaaacaguguugaauu

SEQ ID NO: 3425 - RNA, 20 nt, Artificial Sequence
  Synthetic
auaaacaagaagacuuuguu

SEQ ID NO: 3426 - RNA, 20 nt, Artificial Sequence
  Synthetic
aacaaagcaaacaaguauuu

SEQ ID NO: 3427 - RNA, 20 nt, Artificial Sequence
  Synthetic
uacuuuaaggucuauacuuu

SEQ ID NO: 3428 - RNA, 17 nt, Artificial Sequence
  Synthetic
ggaaagacuggaugaag

SEQ ID NO: 3429 - RNA, 17 nt, Artificial Sequence
  Synthetic
ggcaauuuguaaaucuu

SEQ ID NO: 3430 - RNA, 20 nt, Artificial Sequence
  Synthetic
guauuuuuuucugaagaaaa

SEQ ID NO: 3431 - RNA, 20 nt, Artificial Sequence
  Synthetic
ggugaguaagacacccugaa

SEQ ID NO: 3432 - RNA, 20 nt, Artificial Sequence
  Synthetic
gaauagaacauuuccuuuca

SEQ ID NO: 3433 - RNA, 20 nt, Artificial Sequence
  Synthetic
ggcacauaauaauuaguuuc

SEQ ID NO: 3434 - RNA, 17 nt, Artificial Sequence
  Synthetic
uuuuuuucugaagaaaa

SEQ ID NO: 3435 - RNA, 17 nt, Artificial Sequence
  Synthetic
uuuaucaagauagaaaa

SEQ ID NO: 3436 - RNA, 17 nt, Artificial Sequence
  Synthetic
cuguugcaguauuaaaa

SEQ ID NO: 3437 - RNA, 17 nt, Artificial Sequence
  Synthetic
uuucaagagacuacaaa

SEQ ID NO: 3438 - RNA, 17 nt, Artificial Sequence
  Synthetic
auuuuuuucugaagaaa

SEQ ID NO: 3439 - RNA, 17 nt, Artificial Sequence
  Synthetic
cacauuuuucaaaggca

SEQ ID NO: 3440 - RNA, 17 nt, Artificial Sequence
  Synthetic
aauuuauaagaauauca

SEQ ID NO: 3441 - RNA, 17 nt, Artificial Sequence
  Synthetic
uagaacauuuccuuuca

SEQ ID NO: 3442 - RNA, 17 nt, Artificial Sequence
  Synthetic
aaucaaaauuccucaua

SEQ ID NO: 3443 - RNA, 17 nt, Artificial Sequence
  Synthetic
uauuugauaguacuuua

SEQ ID NO: 3444 - RNA, 17 nt, Artificial Sequence
  Synthetic
ccuggaaaaacaaaucc

SEQ ID NO: 3445 - RNA, 17 nt, Artificial Sequence
  Synthetic
cuugucaucuugauuuc

SEQ ID NO: 3446 - RNA, 17 nt, Artificial Sequence
  Synthetic
uuuuuucugaagaaaag

SEQ ID NO: 3447 - RNA, 17 nt, Artificial Sequence
  Synthetic
uauuuuucauuaccuug

SEQ ID NO: 3448 - RNA, 17 nt, Artificial Sequence
  Synthetic
ucuuaaaagcuuauuug

SEQ ID NO: 3449 - RNA, 17 nt, Artificial Sequence
  Synthetic
uuaucaagauagaaaau

SEQ ID NO: 3450 - RNA, 17 nt, Artificial Sequence
  Synthetic
uuaaacaguguugaauu

SEQ ID NO: 3451 - RNA, 17 nt, Artificial Sequence
  Synthetic
aaagcaaacaaguauuu

SEQ ID NO: 3452 - RNA, 17 nt, Artificial Sequence
  Synthetic
uagagaacucaguuuuu

SEQ ID NO: 3453 - RNA, 20 nt, Artificial Sequence
  Synthetic
auguuuaucaagauagaaaa

SEQ ID NO: 3454 - RNA, 20 nt, Artificial Sequence
  Synthetic
aguauuuuuuucugaagaaa

SEQ ID NO: 3455 - RNA, 20 nt, Artificial Sequence
  Synthetic
aacugaaauuuagauccaca

SEQ ID NO: 3456 - RNA, 20 nt, Artificial Sequence
  Synthetic
aauaauuuauaagaauauca

SEQ ID NO: 3457 - RNA, 20 nt, Artificial Sequence
  Synthetic
agucuucuuguuuauauaac

SEQ ID NO: 3458 - RNA, 20 nt, Artificial Sequence
  Synthetic
uauuuuuuucugaagaaaag

SEQ ID NO: 3459 - RNA, 20 nt, Artificial Sequence
  Synthetic
uauauacaauauaccauaug

SEQ ID NO: 3460 - RNA, 20 nt, Artificial Sequence
  Synthetic
aauuauuuuucauuaccuug

SEQ ID NO: 3461 - RNA, 20 nt, Artificial Sequence
  Synthetic
uguuuaucaagauagaaaau

SEQ ID NO: 3462 - RNA, 20 nt, Artificial Sequence
  Synthetic
aaguaguugaaucauucagu

SEQ ID NO: 3463 - RNA, 20 nt, Artificial Sequence
  Synthetic
agaggcaauuuguaaaucuu

SEQ ID NO: 3464 - RNA, 20 nt, Artificial Sequence
  Synthetic
uuuuagagaacucaguuuuu

SEQ ID NO: 3465 - RNA, 18 nt, Artificial Sequence
  Synthetic
guuuaucaagauagaaaa

SEQ ID NO: 3466 - RNA, 20 nt, Artificial Sequence
  Synthetic
gauccacaaggugauuauaa

SEQ ID NO: 3467 - RNA, 20 nt, Artificial Sequence
  Synthetic
gaauaugcugcuuauaccca

SEQ ID NO: 3468 - RNA, 19 nt, Artificial Sequence
  Synthetic
gacacauuuuucaaaggca

SEQ ID NO: 3469 - RNA, 19 nt, Artificial Sequence
  Synthetic
guuuuuagguugggaaaga

SEQ ID NO: 3470 - RNA, 19 nt, Artificial Sequence
  Synthetic
gcuguaauugcauuguacc

SEQ ID NO: 3471 - RNA, 23 nt, Artificial Sequence
  Synthetic
gcuagcuguaauugcauuguacc

SEQ ID NO: 3472 - RNA, 19 nt, Artificial Sequence
  Synthetic
gugaucuguugaauaaggc

SEQ ID NO: 3473 - RNA, 19 nt, Artificial Sequence
  Synthetic
gcacauaauaauuaguuuc

SEQ ID NO: 3474 - RNA, 20 nt, Artificial Sequence
  Synthetic
gcaccuccucccugagaaug

SEQ ID NO: 3475 - RNA, 22 nt, Artificial Sequence
  Synthetic
gauuaaguccagauuuaucaug

SEQ ID NO: 3476 - RNA, 22 nt, Artificial Sequence
  Synthetic
gauauauacaauauaccauaug

SEQ ID NO: 3477 - RNA, 24 nt, Artificial Sequence
  Synthetic
gugauauauacaauauaccauaug

SEQ ID NO: 3478 - RNA, 18 nt, Artificial Sequence
  Synthetic
guugaaaguuaaacagug

SEQ ID NO: 3479 - RNA, 19 nt, Artificial Sequence
  Synthetic
guguuugugcugauaugau

SEQ ID NO: 3480 - RNA, 20 nt, Artificial Sequence
  Synthetic
gguguuugugcugauaugau

SEQ ID NO: 3481 - RNA, 19 nt, Artificial Sequence
  Synthetic
gucuuucccaaccuaaaaa

SEQ ID NO: 3482 - RNA, 20 nt, Artificial Sequence
  Synthetic
guucaaugauauaaggaaac

SEQ ID NO: 3483 - RNA, 23 nt, Artificial Sequence
  Synthetic
gcaguucaaugauauaaggaaac

SEQ ID NO: 3484 - RNA, 18 nt, Artificial Sequence
  Synthetic
guaaugaaaaauaauuac

SEQ ID NO: 3485 - RNA, 19 nt, Artificial Sequence
  Synthetic
gguaaugaaaaauaauuac

SEQ ID NO: 3486 - RNA, 21 nt, Artificial Sequence
  Synthetic
gaaauaauuuauaagaauauc

SEQ ID NO: 3487 - RNA, 22 nt, Artificial Sequence
  Synthetic
gauaaacauugguguaaaguag

SEQ ID NO: 3488 - RNA, 23 nt, Artificial Sequence
  Synthetic
guuauauaaacaagaagacuuug

SEQ ID NO: 3489 - RNA, 19 nt, Artificial Sequence
  Synthetic
gaaaacacugacuuagauu

SEQ ID NO: 3490 - RNA, 20 nt, Artificial Sequence
  Synthetic
guacuuuaaggucuauacuu

SEQ ID NO: 3491 - RNA, 24 nt, Artificial Sequence
  Synthetic
gauaguacuuuaaggucuauacuu

SEQ ID NO: 3492 - RNA, 20 nt, Artificial Sequence
  Synthetic
gauucaauuauaaucaccuu

SEQ ID NO: 3493 - RNA, 19 nt, Artificial Sequence
  Synthetic
uguuuaucaagauagaaaa

SEQ ID NO: 3494 - RNA, 18 nt, Artificial Sequence
  Synthetic
uccacaaggugauuauaa

SEQ ID NO: 3495 - RNA, 19 nt, Artificial Sequence
  Synthetic
auccacaaggugauuauaa

SEQ ID NO: 3496 - RNA, 18 nt, Artificial Sequence
  Synthetic
auaugcugcuuauaccca

SEQ ID NO: 3497 - RNA, 19 nt, Artificial Sequence
  Synthetic
aauaugcugcuuauaccca

SEQ ID NO: 3498 - RNA, 18 nt, Artificial Sequence
  Synthetic
acacauuuuucaaaggca

SEQ ID NO: 3499 - RNA, 21 nt, Artificial Sequence
  Synthetic
cugacacauuuuucaaaggca

SEQ ID NO: 3500 - RNA, 22 nt, Artificial Sequence
  Synthetic
ucugacacauuuuucaaaggca

SEQ ID NO: 3501 - RNA, 23 nt, Artificial Sequence
  Synthetic
aucugacacauuuuucaaaggca

SEQ ID NO: 3502 - RNA, 24 nt, Artificial Sequence
  Synthetic
uaucugacacauuuuucaaaggca

SEQ ID NO: 3503 - RNA, 18 nt, Artificial Sequence
  Synthetic
uuuuuagguugggaaaga

SEQ ID NO: 3504 - RNA, 20 nt, Artificial Sequence
  Synthetic
aguuuuuagguugggaaaga

SEQ ID NO: 3505 - RNA, 21 nt, Artificial Sequence
  Synthetic
caguuuuuagguugggaaaga

SEQ ID NO: 3506 - RNA, 22 nt, Artificial Sequence
  Synthetic
ucaguuuuuagguugggaaaga

SEQ ID NO: 3507 - RNA, 23 nt, Artificial Sequence
  Synthetic
cucaguuuuuagguugggaaaga

SEQ ID NO: 3508 - RNA, 24 nt, Artificial Sequence
  Synthetic
acucaguuuuuagguugggaaaga

SEQ ID NO: 3509 - RNA, 18 nt, Artificial Sequence
  Synthetic
cuguaauugcauuguacc

SEQ ID NO: 3510 - RNA, 20 nt, Artificial Sequence
  Synthetic
agcuguaauugcauuguacc

SEQ ID NO: 3511 - RNA, 21 nt, Artificial Sequence
  Synthetic
uagcuguaauugcauuguacc

SEQ ID NO: 3512 - RNA, 22 nt, Artificial Sequence
  Synthetic
cuagcuguaauugcauuguacc

SEQ ID NO: 3513 - RNA, 24 nt, Artificial Sequence
  Synthetic
ugcuagcuguaauugcauuguacc

SEQ ID NO: 3514 - RNA, 18 nt, Artificial Sequence
  Synthetic
ugaucuguugaauaaggc

SEQ ID NO: 3515 - RNA, 20 nt, Artificial Sequence
  Synthetic
agugaucuguugaauaaggc

SEQ ID NO: 3516 - RNA, 21 nt, Artificial Sequence
  Synthetic
cagugaucuguugaauaaggc

SEQ ID NO: 3517 - RNA, 22 nt, Artificial Sequence
  Synthetic
ucagugaucuguugaauaaggc

SEQ ID NO: 3518 - RNA, 23 nt, Artificial Sequence
  Synthetic
cucagugaucuguugaauaaggc

SEQ ID NO: 3519 - RNA, 24 nt, Artificial Sequence
  Synthetic
ucucagugaucuguugaauaaggc

SEQ ID NO: 3520 - RNA, 18 nt, Artificial Sequence
  Synthetic
cacauaauaauuaguuuc

SEQ ID NO: 3521 - RNA, 21 nt, Artificial Sequence
  Synthetic
uggcacauaauaauuaguuuc

SEQ ID NO: 3522 - RNA, 22 nt, Artificial Sequence
  Synthetic
cuggcacauaauaauuaguuuc

SEQ ID NO: 3523 - RNA, 23 nt, Artificial Sequence
  Synthetic
acuggcacauaauaauuaguuuc

SEQ ID NO: 3524 - RNA, 24 nt, Artificial Sequence
  Synthetic
aacuggcacauaauaauuaguuuc

SEQ ID NO: 3525 - RNA, 18 nt, Artificial Sequence
  Synthetic
accuccucccugagaaug

SEQ ID NO: 3526 - RNA, 19 nt, Artificial Sequence
  Synthetic
caccuccucccugagaaug

SEQ ID NO: 3527 - RNA, 21 nt, Artificial Sequence
  Synthetic
ugcaccuccucccugagaaug

SEQ ID NO: 3528 - RNA, 22 nt, Artificial Sequence
  Synthetic
augcaccuccucccugagaaug

SEQ ID NO: 3529 - RNA, 23 nt, Artificial Sequence
  Synthetic
aaugcaccuccucccugagaaug

SEQ ID NO: 3530 - RNA, 24 nt, Artificial Sequence
  Synthetic
caaugcaccuccucccugagaaug

SEQ ID NO: 3531 - RNA, 18 nt, Artificial Sequence
  Synthetic
aaguccagauuuaucaug

SEQ ID NO: 3532 - RNA, 19 nt, Artificial Sequence
  Synthetic
uaaguccagauuuaucaug

SEQ ID NO: 3533 - RNA, 20 nt, Artificial Sequence
  Synthetic
uuaaguccagauuuaucaug

SEQ ID NO: 3534 - RNA, 21 nt, Artificial Sequence
  Synthetic
auuaaguccagauuuaucaug

SEQ ID NO: 3535 - RNA, 23 nt, Artificial Sequence
  Synthetic
ugauuaaguccagauuuaucaug

SEQ ID NO: 3536 - RNA, 24 nt, Artificial Sequence
  Synthetic
uugauuaaguccagauuuaucaug

SEQ ID NO: 3537 - RNA, 18 nt, Artificial Sequence
  Synthetic
uauacaauauaccauaug

SEQ ID NO: 3538 - RNA, 19 nt, Artificial Sequence
  Synthetic
auauacaauauaccauaug

SEQ ID NO: 3539 - RNA, 21 nt, Artificial Sequence
  Synthetic
auauauacaauauaccauaug

SEQ ID NO: 3540 - RNA, 23 nt, Artificial Sequence
  Synthetic
ugauauauacaauauaccauaug

SEQ ID NO: 3541 - RNA, 18 nt, Artificial Sequence
  Synthetic
aggcuucucagugaucug

SEQ ID NO: 3542 - RNA, 19 nt, Artificial Sequence
  Synthetic
caggcuucucagugaucug

SEQ ID NO: 3543 - RNA, 20 nt, Artificial Sequence
  Synthetic
ccaggcuucucagugaucug

SEQ ID NO: 3544 - RNA, 21 nt, Artificial Sequence
  Synthetic
uccaggcuucucagugaucug

SEQ ID NO: 3545 - RNA, 22 nt, Artificial Sequence
  Synthetic
uuccaggcuucucagugaucug

SEQ ID NO: 3546 - RNA, 23 nt, Artificial Sequence
  Synthetic
uuuccaggcuucucagugaucug

SEQ ID NO: 3547 - RNA, 24 nt, Artificial Sequence
  Synthetic
uuuuccaggcuucucagugaucug

SEQ ID NO: 3548 - RNA, 19 nt, Artificial Sequence
  Synthetic
uguugaaaguuaaacagug

SEQ ID NO: 3549 - RNA, 20 nt, Artificial Sequence
  Synthetic
auguugaaaguuaaacagug

SEQ ID NO: 3550 - RNA, 21 nt, Artificial Sequence
  Synthetic
uauguugaaaguuaaacagug

SEQ ID NO: 3551 - RNA, 22 nt, Artificial Sequence
  Synthetic
auauguugaaaguuaaacagug

SEQ ID NO: 3552 - RNA, 23 nt, Artificial Sequence
  Synthetic
aauauguugaaaguuaaacagug

SEQ ID NO: 3553 - RNA, 24 nt, Artificial Sequence
  Synthetic
uaauauguugaaaguuaaacagug

SEQ ID NO: 3554 - RNA, 18 nt, Artificial Sequence
  Synthetic
uguuugugcugauaugau

SEQ ID NO: 3555 - RNA, 21 nt, Artificial Sequence
  Synthetic
agguguuugugcugauaugau

SEQ ID NO: 3556 - RNA, 22 nt, Artificial Sequence
  Synthetic
uagguguuugugcugauaugau

SEQ ID NO: 3557 - RNA, 23 nt, Artificial Sequence
  Synthetic
uuagguguuugugcugauaugau

SEQ ID NO: 3558 - RNA, 24 nt, Artificial Sequence
  Synthetic
uuuagguguuugugcugauaugau

SEQ ID NO: 3559 - RNA, 18 nt, Artificial Sequence
  Synthetic
ucaaugcaccuccucccu

SEQ ID NO: 3560 - RNA, 19 nt, Artificial Sequence
  Synthetic
uucaaugcaccuccucccu

SEQ ID NO: 3561 - RNA, 20 nt, Artificial Sequence
  Synthetic
cuucaaugcaccuccucccu

SEQ ID NO: 3562 - RNA, 21 nt, Artificial Sequence
  Synthetic
acuucaaugcaccuccucccu

SEQ ID NO: 3563 - RNA, 22 nt, Artificial Sequence
  Synthetic
aacuucaaugcaccuccucccu

SEQ ID NO: 3564 - RNA, 23 nt, Artificial Sequence
  Synthetic
uaacuucaaugcaccuccucccu

SEQ ID NO: 3565 - RNA, 24 nt, Artificial Sequence
  Synthetic
auaacuucaaugcaccuccucccu

SEQ ID NO: 3566 - RNA, 18 nt, Artificial Sequence
  Synthetic
uuaaugaaacauaguauu

SEQ ID NO: 3567 - RNA, 19 nt, Artificial Sequence
  Synthetic
auuaaugaaacauaguauu

SEQ ID NO: 3568 - RNA, 20 nt, Artificial Sequence
  Synthetic
uauuaaugaaacauaguauu

SEQ ID NO: 3569 - RNA, 21 nt, Artificial Sequence
  Synthetic
uuauuaaugaaacauaguauu

SEQ ID NO: 3570 - RNA, 22 nt, Artificial Sequence
  Synthetic
auuauuaaugaaacauaguauu

SEQ ID NO: 3571 - RNA, 23 nt, Artificial Sequence
  Synthetic
aauuauuaaugaaacauaguauu

SEQ ID NO: 3572 - RNA, 24 nt, Artificial Sequence
  Synthetic
uaauuauuaaugaaacauaguauu

SEQ ID NO: 3573 - RNA, 21 nt, Artificial Sequence
  Synthetic
caugaauagaacauuuccuuu

SEQ ID NO: 3574 - RNA, 22 nt, Artificial Sequence
  Synthetic
ccaugaauagaacauuuccuuu

SEQ ID NO: 3575 - RNA, 23 nt, Artificial Sequence
  Synthetic
accaugaauagaacauuuccuuu

SEQ ID NO: 3576 - RNA, 24 nt, Artificial Sequence
  Synthetic
uaccaugaauagaacauuuccuuu

SEQ ID NO: 3577 - RNA, 18 nt, Artificial Sequence
  Synthetic
ucuuucccaaccuaaaaa

SEQ ID NO: 3578 - RNA, 20 nt, Artificial Sequence
  Synthetic
agucuuucccaaccuaaaaa

SEQ ID NO: 3579 - RNA, 21 nt, Artificial Sequence
  Synthetic
cagucuuucccaaccuaaaaa

SEQ ID NO: 3580 - RNA, 22 nt, Artificial Sequence
  Synthetic
ccagucuuucccaaccuaaaaa

SEQ ID NO: 3581 - RNA, 23 nt, Artificial Sequence
  Synthetic
uccagucuuucccaaccuaaaaa

SEQ ID NO: 3582 - RNA, 24 nt, Artificial Sequence
  Synthetic
auccagucuuucccaaccuaaaaa

SEQ ID NO: 3583 - RNA, 18 nt, Artificial Sequence
  Synthetic
aaguaguugaaucauuca

SEQ ID NO: 3584 - RNA, 19 nt, Artificial Sequence
  Synthetic
aaaguaguugaaucauuca

SEQ ID NO: 3585 - RNA, 20 nt, Artificial Sequence
  Synthetic
uaaaguaguugaaucauuca

SEQ ID NO: 3586 - RNA, 18 nt, Artificial Sequence
  Synthetic
auuguauauaucacagua

SEQ ID NO: 3587 - RNA, 19 nt, Artificial Sequence
  Synthetic
uauuguauauaucacagua

SEQ ID NO: 3588 - RNA, 20 nt, Artificial Sequence
  Synthetic
auauuguauauaucacagua

SEQ ID NO: 3589 - RNA, 18 nt, Artificial Sequence
  Synthetic
ucaaugauauaaggaaac

SEQ ID NO: 3590 - RNA, 19 nt, Artificial Sequence
  Synthetic
uucaaugauauaaggaaac

SEQ ID NO: 3591 - RNA, 21 nt, Artificial Sequence
  Synthetic
aguucaaugauauaaggaaac

SEQ ID NO: 3592 - RNA, 22 nt, Artificial Sequence
  Synthetic
caguucaaugauauaaggaaac

SEQ ID NO: 3593 - RNA, 24 nt, Artificial Sequence
  Synthetic
agcaguucaaugauauaaggaaac

SEQ ID NO: 3594 - RNA, 20 nt, Artificial Sequence
  Synthetic
agguaaugaaaaauaauuac

SEQ ID NO: 3595 - RNA, 22 nt, Artificial Sequence
  Synthetic
agaaauaauuuauaagaauauc

SEQ ID NO: 3596 - RNA, 23 nt, Artificial Sequence
  Synthetic
cagaaauaauuuauaagaauauc

SEQ ID NO: 3597 - RNA, 24 nt, Artificial Sequence
  Synthetic
ucagaaauaauuuauaagaauauc

SEQ ID NO: 3598 - RNA, 18 nt, Artificial Sequence
  Synthetic
aacauugguguaaaguag

SEQ ID NO: 3599 - RNA, 19 nt, Artificial Sequence
  Synthetic
aaacauugguguaaaguag

SEQ ID NO: 3600 - RNA, 20 nt, Artificial Sequence
  Synthetic
uaaacauugguguaaaguag

SEQ ID NO: 3601 - RNA, 21 nt, Artificial Sequence
  Synthetic
auaaacauugguguaaaguag

SEQ ID NO: 3602 - RNA, 23 nt, Artificial Sequence
  Synthetic
ugauaaacauugguguaaaguag

SEQ ID NO: 3603 - RNA, 24 nt, Artificial Sequence
  Synthetic
uugauaaacauugguguaaaguag

SEQ ID NO: 3604 - RNA, 18 nt, Artificial Sequence
  Synthetic
uguugcaguauuaaaaug

SEQ ID NO: 3605 - RNA, 19 nt, Artificial Sequence
  Synthetic
cuguugcaguauuaaaaug

SEQ ID NO: 3606 - RNA, 20 nt, Artificial Sequence
  Synthetic
ucuguugcaguauuaaaaug

SEQ ID NO: 3607 - RNA, 21 nt, Artificial Sequence
  Synthetic
aucuguugcaguauuaaaaug

SEQ ID NO: 3608 - RNA, 22 nt, Artificial Sequence
  Synthetic
caucuguugcaguauuaaaaug

SEQ ID NO: 3609 - RNA, 23 nt, Artificial Sequence
  Synthetic
ccaucuguugcaguauuaaaaug

SEQ ID NO: 3610 - RNA, 24 nt, Artificial Sequence
  Synthetic
uccaucuguugcaguauuaaaaug

SEQ ID NO: 3611 - RNA, 18 nt, Artificial Sequence
  Synthetic
auaaacaagaagacuuug

SEQ ID NO: 3612 - RNA, 19 nt, Artificial Sequence
  Synthetic
uauaaacaagaagacuuug

SEQ ID NO: 3613 - RNA, 20 nt, Artificial Sequence
  Synthetic
auauaaacaagaagacuuug

SEQ ID NO: 3614 - RNA, 21 nt, Artificial Sequence
  Synthetic
uauauaaacaagaagacuuug

SEQ ID NO: 3615 - RNA, 22 nt, Artificial Sequence
  Synthetic
uuauauaaacaagaagacuuug

SEQ ID NO: 3616 - RNA, 24 nt, Artificial Sequence
  Synthetic
aguuauauaaacaagaagacuuug

SEQ ID NO: 3617 - RNA, 18 nt, Artificial Sequence
  Synthetic
aaaacacugacuuagauu

SEQ ID NO: 3618 - RNA, 20 nt, Artificial Sequence
  Synthetic
agaaaacacugacuuagauu

SEQ ID NO: 3619 - RNA, 21 nt, Artificial Sequence
  Synthetic
uagaaaacacugacuuagauu

SEQ ID NO: 3620 - RNA, 22 nt, Artificial Sequence
  Synthetic
uuagaaaacacugacuuagauu

SEQ ID NO: 3621 - RNA, 23 nt, Artificial Sequence
  Synthetic
auuagaaaacacugacuuagauu

SEQ ID NO: 3622 - RNA, 24 nt, Artificial Sequence
  Synthetic
uauuagaaaacacugacuuagauu

SEQ ID NO: 3623 - RNA, 18 nt, Artificial Sequence
  Synthetic
acuuuaaggucuauacuu

SEQ ID NO: 3624 - RNA, 19 nt, Artificial Sequence
  Synthetic
uacuuuaaggucuauacuu

SEQ ID NO: 3625 - RNA, 21 nt, Artificial Sequence
  Synthetic
aguacuuuaaggucuauacuu

SEQ ID NO: 3626 - RNA, 22 nt, Artificial Sequence
  Synthetic
uaguacuuuaaggucuauacuu

SEQ ID NO: 3627 - RNA, 23 nt, Artificial Sequence
  Synthetic
auaguacuuuaaggucuauacuu

SEQ ID NO: 3628 - RNA, 18 nt, Artificial Sequence
  Synthetic
uucaauuauaaucaccuu

SEQ ID NO: 3629 - RNA, 19 nt, Artificial Sequence
  Synthetic
auucaauuauaaucaccuu

SEQ ID NO: 3630 - RNA, 21 nt, Artificial Sequence
  Synthetic
agauucaauuauaaucaccuu

SEQ ID NO: 3631 - RNA, 22 nt, Artificial Sequence
  Synthetic
aagauucaauuauaaucaccuu

SEQ ID NO: 3632 - RNA, 23 nt, Artificial Sequence
  Synthetic
aaagauucaauuauaaucaccuu

SEQ ID NO: 3633 - RNA, 24 nt, Artificial Sequence
  Synthetic
aaaagauucaauuauaaucaccuu

SEQ ID NO: 3634 - RNA, 21 nt, Artificial Sequence
  Synthetic
aauguuuaucaagauagaaaa

SEQ ID NO: 3635 - RNA, 22 nt, Artificial Sequence
  Synthetic
caauguuuaucaagauagaaaa

SEQ ID NO: 3636 - RNA, 23 nt, Artificial Sequence
  Synthetic
ccaauguuuaucaagauagaaaa

SEQ ID NO: 3637 - RNA, 24 nt, Artificial Sequence
  Synthetic
accaauguuuaucaagauagaaaa

SEQ ID NO: 3638 - RNA, 21 nt, Artificial Sequence
  Synthetic
agauccacaaggugauuauaa

SEQ ID NO: 3639 - RNA, 22 nt, Artificial Sequence
  Synthetic
uagauccacaaggugauuauaa

SEQ ID NO: 3640 - RNA, 23 nt, Artificial Sequence
  Synthetic
uuagauccacaaggugauuauaa

SEQ ID NO: 3641 - RNA, 24 nt, Artificial Sequence
  Synthetic
uuuagauccacaaggugauuauaa

SEQ ID NO: 3642 - RNA, 21 nt, Artificial Sequence
  Synthetic
agaauaugcugcuuauaccca

SEQ ID NO: 3643 - RNA, 22 nt, Artificial Sequence
  Synthetic
gagaauaugcugcuuauaccca

SEQ ID NO: 3644 - RNA, 23 nt, Artificial Sequence
  Synthetic
ugagaauaugcugcuuauaccca

SEQ ID NO: 3645 - RNA, 24 nt, Artificial Sequence
  Synthetic
uugagaauaugcugcuuauaccca

SEQ ID NO: 3646 - RNA, 18 nt, Artificial Sequence
  Synthetic
gaauagaacauuuccuuu

SEQ ID NO: 3647 - RNA, 19 nt, Artificial Sequence
  Synthetic
ugaauagaacauuuccuuu

SEQ ID NO: 3648 - RNA, 20 nt, Artificial Sequence
  Synthetic
augaauagaacauuuccuuu

SEQ ID NO: 3649 - RNA, 21 nt, Artificial Sequence
  Synthetic
guaaaguaguugaaucauuca

SEQ ID NO: 3650 - RNA, 22 nt, Artificial Sequence
  Synthetic
uguaaaguaguugaaucauuca

SEQ ID NO: 3651 - RNA, 23 nt, Artificial Sequence
  Synthetic
guguaaaguaguugaaucauuca

SEQ ID NO: 3652 - RNA, 24 nt, Artificial Sequence
  Synthetic
gguguaaaguaguugaaucauuca

SEQ ID NO: 3653 - RNA, 21 nt, Artificial Sequence
  Synthetic
uauauuguauauaucacagua

SEQ ID NO: 3654 - RNA, 22 nt, Artificial Sequence
  Synthetic
guauauuguauauaucacagua

SEQ ID NO: 3655 - RNA, 23 nt, Artificial Sequence
  Synthetic
gguauauuguauauaucacagua

SEQ ID NO: 3656 - RNA, 24 nt, Artificial Sequence
  Synthetic
ugguauauuguauauaucacagua

SEQ ID NO: 3657 - RNA, 21 nt, Artificial Sequence
  Synthetic
aagguaaugaaaaauaauuac

SEQ ID NO: 3658 - RNA, 22 nt, Artificial Sequence
  Synthetic
caagguaaugaaaaauaauuac

SEQ ID NO: 3659 - RNA, 23 nt, Artificial Sequence
  Synthetic
acaagguaaugaaaaauaauuac

SEQ ID NO: 3660 - RNA, 24 nt, Artificial Sequence
  Synthetic
cacaagguaaugaaaaauaauuac

SEQ ID NO: 3661 - RNA, 18 nt, Artificial Sequence
  Synthetic
auaauuuauaagaauauc

SEQ ID NO: 3662 - RNA, 19 nt, Artificial Sequence
  Synthetic
aauaauuuauaagaauauc

SEQ ID NO: 3663 - RNA, 20 nt, Artificial Sequence
  Synthetic
aaauaauuuauaagaauauc

SEQ ID NO: 3664 - RNA, 18 nt, Artificial Sequence
  Synthetic
auuucagaaauaauuuau

SEQ ID NO: 3665 - RNA, 19 nt, Artificial Sequence
  Synthetic
aauuucagaaauaauuuau

SEQ ID NO: 3666 - RNA, 20 nt, Artificial Sequence
  Synthetic
aaauuucagaaauaauuuau

SEQ ID NO: 3667 - RNA, 21 nt, Artificial Sequence
  Synthetic
gaaauuucagaaauaauuuau

SEQ ID NO: 3668 - RNA, 22 nt, Artificial Sequence
  Synthetic
agaaauuucagaaauaauuuau

SEQ ID NO: 3669 - RNA, 23 nt, Artificial Sequence
  Synthetic
cagaaauuucagaaauaauuuau

SEQ ID NO: 3670 - RNA, 24 nt, Artificial Sequence
  Synthetic
acagaaauuucagaaauaauuuau

SEQ ID NO: 3671 - RNA, 18 nt, Artificial Sequence
  Synthetic
uuuucaagagacuacaaa

SEQ ID NO: 3672 - RNA, 19 nt, Artificial Sequence
  Synthetic
auuuucaagagacuacaaa

SEQ ID NO: 3673 - RNA, 21 nt, Artificial Sequence
  Synthetic
guauuuucaagagacuacaaa

SEQ ID NO: 3674 - RNA, 22 nt, Artificial Sequence
  Synthetic
uguauuuucaagagacuacaaa

SEQ ID NO: 3675 - RNA, 23 nt, Artificial Sequence
  Synthetic
cuguauuuucaagagacuacaaa

SEQ ID NO: 3676 - RNA, 24 nt, Artificial Sequence
  Synthetic
ucuguauuuucaagagacuacaaa

SEQ ID NO: 3677 - RNA, 18 nt, Artificial Sequence
  Synthetic
uguuuaucaagauagaaa

SEQ ID NO: 3678 - RNA, 19 nt, Artificial Sequence
  Synthetic
auguuuaucaagauagaaa

SEQ ID NO: 3679 - RNA, 20 nt, Artificial Sequence
  Synthetic
aauguuuaucaagauagaaa

SEQ ID NO: 3680 - RNA, 21 nt, Artificial Sequence
  Synthetic
caauguuuaucaagauagaaa

SEQ ID NO: 3681 - RNA, 22 nt, Artificial Sequence
  Synthetic
ccaauguuuaucaagauagaaa

SEQ ID NO: 3682 - RNA, 23 nt, Artificial Sequence
  Synthetic
accaauguuuaucaagauagaaa

SEQ ID NO: 3683 - RNA, 24 nt, Artificial Sequence
  Synthetic
caccaauguuuaucaagauagaaa

SEQ ID NO: 3684 - RNA, 18 nt, Artificial Sequence
  Synthetic
auuuucaagagacuacaa

SEQ ID NO: 3685 - RNA, 19 nt, Artificial Sequence
  Synthetic
uauuuucaagagacuacaa

SEQ ID NO: 3686 - RNA, 20 nt, Artificial Sequence
  Synthetic
guauuuucaagagacuacaa

SEQ ID NO: 3687 - RNA, 21 nt, Artificial Sequence
  Synthetic
uguauuuucaagagacuacaa

SEQ ID NO: 3688 - RNA, 22 nt, Artificial Sequence
  Synthetic
cuguauuuucaagagacuacaa

SEQ ID NO: 3689 - RNA, 23 nt, Artificial Sequence
  Synthetic
ucuguauuuucaagagacuacaa

SEQ ID NO: 3690 - RNA, 24 nt, Artificial Sequence
  Synthetic
uucuguauuuucaagagacuacaa

SEQ ID NO: 3691 - RNA, 18 nt, Artificial Sequence
  Synthetic
aucaagaugacaagucaa

SEQ ID NO: 3692 - RNA, 19 nt, Artificial Sequence
  Synthetic
aaucaagaugacaagucaa

SEQ ID NO: 3693 - RNA, 20 nt, Artificial Sequence
  Synthetic
aaaucaagaugacaagucaa

SEQ ID NO: 3694 - RNA, 21 nt, Artificial Sequence
  Synthetic
gaaaucaagaugacaagucaa

SEQ ID NO: 3695 - RNA, 22 nt, Artificial Sequence
  Synthetic
agaaaucaagaugacaagucaa

SEQ ID NO: 3696 - RNA, 23 nt, Artificial Sequence
  Synthetic
cagaaaucaagaugacaagucaa

SEQ ID NO: 3697 - RNA, 24 nt, Artificial Sequence
  Synthetic
ccagaaaucaagaugacaagucaa

SEQ ID NO: 3698 - RNA, 18 nt, Artificial Sequence
  Synthetic
auugcauuguaccaugaa

SEQ ID NO: 3699 - RNA, 19 nt, Artificial Sequence
  Synthetic
aauugcauuguaccaugaa

SEQ ID NO: 3700 - RNA, 20 nt, Artificial Sequence
  Synthetic
uaauugcauuguaccaugaa

SEQ ID NO: 3701 - RNA, 21 nt, Artificial Sequence
  Synthetic
guaauugcauuguaccaugaa

SEQ ID NO: 3702 - RNA, 22 nt, Artificial Sequence
  Synthetic
uguaauugcauuguaccaugaa

SEQ ID NO: 3703 - RNA, 23 nt, Artificial Sequence
  Synthetic
cuguaauugcauuguaccaugaa

SEQ ID NO: 3704 - RNA, 24 nt, Artificial Sequence
  Synthetic
gcuguaauugcauuguaccaugaa

SEQ ID NO: 3705 - RNA, 18 nt, Artificial Sequence
  Synthetic
caaauaucuauuuaauca

SEQ ID NO: 3706 - RNA, 19 nt, Artificial Sequence
  Synthetic
ucaaauaucuauuuaauca

SEQ ID NO: 3707 - RNA, 20 nt, Artificial Sequence
  Synthetic
aucaaauaucuauuuaauca

SEQ ID NO: 3708 - RNA, 21 nt, Artificial Sequence
  Synthetic
uaucaaauaucuauuuaauca

SEQ ID NO: 3709 - RNA, 22 nt, Artificial Sequence
  Synthetic
cuaucaaauaucuauuuaauca

SEQ ID NO: 3710 - RNA, 23 nt, Artificial Sequence
  Synthetic
acuaucaaauaucuauuuaauca

SEQ ID NO: 3711 - RNA, 24 nt, Artificial Sequence
  Synthetic
uacuaucaaauaucuauuuaauca

SEQ ID NO: 3712 - RNA, 18 nt, Artificial Sequence
  Synthetic
ucugguuuccuuauauca

SEQ ID NO: 3713 - RNA, 19 nt, Artificial Sequence
  Synthetic
cucugguuuccuuauauca

SEQ ID NO: 3714 - RNA, 20 nt, Artificial Sequence
  Synthetic
acucugguuuccuuauauca

SEQ ID NO: 3715 - RNA, 21 nt, Artificial Sequence
  Synthetic
uacucugguuuccuuauauca

SEQ ID NO: 3716 - RNA, 22 nt, Artificial Sequence
  Synthetic
uuacucugguuuccuuauauca

SEQ ID NO: 3717 - RNA, 23 nt, Artificial Sequence
  Synthetic
auuacucugguuuccuuauauca

SEQ ID NO: 3718 - RNA, 24 nt, Artificial Sequence
  Synthetic
uauuacucugguuuccuuauauca

SEQ ID NO: 3719 - RNA, 18 nt, Artificial Sequence
  Synthetic
caccaauguuuaucaaga

SEQ ID NO: 3720 - RNA, 19 nt, Artificial Sequence
  Synthetic
acaccaauguuuaucaaga

SEQ ID NO: 3721 - RNA, 20 nt, Artificial Sequence
  Synthetic
uacaccaauguuuaucaaga

SEQ ID NO: 3722 - RNA, 21 nt, Artificial Sequence
  Synthetic
uuacaccaauguuuaucaaga

SEQ ID NO: 3723 - RNA, 22 nt, Artificial Sequence
  Synthetic
uuuacaccaauguuuaucaaga

SEQ ID NO: 3724 - RNA, 23 nt, Artificial Sequence
  Synthetic
cuuuacaccaauguuuaucaaga

SEQ ID NO: 3725 - RNA, 24 nt, Artificial Sequence
  Synthetic
acuuuacaccaauguuuaucaaga

SEQ ID NO: 3726 - RNA, 18 nt, Artificial Sequence
  Synthetic
uuuuaauacugcaacaga

SEQ ID NO: 3727 - RNA, 19 nt, Artificial Sequence
  Synthetic
auuuuaauacugcaacaga

SEQ ID NO: 3728 - RNA, 21 nt, Artificial Sequence
  Synthetic
ccauuuuaauacugcaacaga

SEQ ID NO: 3729 - RNA, 22 nt, Artificial Sequence
  Synthetic
accauuuuaauacugcaacaga

SEQ ID NO: 3730 - RNA, 23 nt, Artificial Sequence
  Synthetic
caccauuuuaauacugcaacaga

SEQ ID NO: 3731 - RNA, 24 nt, Artificial Sequence
  Synthetic
ucaccauuuuaauacugcaacaga

SEQ ID NO: 3732 - RNA, 18 nt, Artificial Sequence
  Synthetic
uauuaaugaaacauagua

SEQ ID NO: 3733 - RNA, 19 nt, Artificial Sequence
  Synthetic
uuauuaaugaaacauagua

SEQ ID NO: 3734 - RNA, 20 nt, Artificial Sequence
  Synthetic
auuauuaaugaaacauagua

SEQ ID NO: 3735 - RNA, 21 nt, Artificial Sequence
  Synthetic
aauuauuaaugaaacauagua

SEQ ID NO: 3736 - RNA, 22 nt, Artificial Sequence
  Synthetic
uaauuauuaaugaaacauagua

SEQ ID NO: 3737 - RNA, 23 nt, Artificial Sequence
  Synthetic
uuaauuauuaaugaaacauagua

SEQ ID NO: 3738 - RNA, 24 nt, Artificial Sequence
  Synthetic
auuaauuauuaaugaaacauagua

SEQ ID NO: 3739 - RNA, 18 nt, Artificial Sequence
  Synthetic
uaucucuauuaauuauua

SEQ ID NO: 3740 - RNA, 19 nt, Artificial Sequence
  Synthetic
auaucucuauuaauuauua

SEQ ID NO: 3741 - RNA, 20 nt, Artificial Sequence
  Synthetic
uauaucucuauuaauuauua

SEQ ID NO: 3742 - RNA, 21 nt, Artificial Sequence
  Synthetic
auauaucucuauuaauuauua

SEQ ID NO: 3743 - RNA, 22 nt, Artificial Sequence
  Synthetic
cauauaucucuauuaauuauua

SEQ ID NO: 3744 - RNA, 23 nt, Artificial Sequence
  Synthetic
ucauauaucucuauuaauuauua

SEQ ID NO: 3745 - RNA, 24 nt, Artificial Sequence
  Synthetic
uucauauaucucuauuaauuauua

SEQ ID NO: 3746 - RNA, 18 nt, Artificial Sequence
  Synthetic
aaaauacuaaaauuuuua

SEQ ID NO: 3747 - RNA, 19 nt, Artificial Sequence
  Synthetic
aaaaauacuaaaauuuuua

SEQ ID NO: 3748 - RNA, 20 nt, Artificial Sequence
  Synthetic
aaaaaauacuaaaauuuuua

SEQ ID NO: 3749 - RNA, 21 nt, Artificial Sequence
  Synthetic
aaaaaaauacuaaaauuuuua

SEQ ID NO: 3750 - RNA, 22 nt, Artificial Sequence
  Synthetic
gaaaaaaauacuaaaauuuuua

SEQ ID NO: 3751 - RNA, 23 nt, Artificial Sequence
  Synthetic
agaaaaaaauacuaaaauuuuua

SEQ ID NO: 3752 - RNA, 24 nt, Artificial Sequence
  Synthetic
cagaaaaaaauacuaaaauuuuua

SEQ ID NO: 3753 - RNA, 18 nt, Artificial Sequence
  Synthetic
cuucaaugcaccuccucc

SEQ ID NO: 3754 - RNA, 19 nt, Artificial Sequence
  Synthetic
acuucaaugcaccuccucc

SEQ ID NO: 3755 - RNA, 20 nt, Artificial Sequence
  Synthetic
aacuucaaugcaccuccucc

SEQ ID NO: 3756 - RNA, 21 nt, Artificial Sequence
  Synthetic
uaacuucaaugcaccuccucc

SEQ ID NO: 3757 - RNA, 22 nt, Artificial Sequence
  Synthetic
auaacuucaaugcaccuccucc

SEQ ID NO: 3758 - RNA, 23 nt, Artificial Sequence
  Synthetic
aauaacuucaaugcaccuccucc

SEQ ID NO: 3759 - RNA, 24 nt, Artificial Sequence
  Synthetic
uaauaacuucaaugcaccuccucc

SEQ ID NO: 3760 - RNA, 18 nt, Artificial Sequence
  Synthetic
gacacauuuuucaaaggc

SEQ ID NO: 3761 - RNA, 19 nt, Artificial Sequence
  Synthetic
ugacacauuuuucaaaggc

SEQ ID NO: 3762 - RNA, 20 nt, Artificial Sequence
  Synthetic
cugacacauuuuucaaaggc

SEQ ID NO: 3763 - RNA, 21 nt, Artificial Sequence
  Synthetic
ucugacacauuuuucaaaggc

SEQ ID NO: 3764 - RNA, 22 nt, Artificial Sequence
  Synthetic
aucugacacauuuuucaaaggc

SEQ ID NO: 3765 - RNA, 23 nt, Artificial Sequence
  Synthetic
uaucugacacauuuuucaaaggc

SEQ ID NO: 3766 - RNA, 24 nt, Artificial Sequence
  Synthetic
auaucugacacauuuuucaaaggc

SEQ ID NO: 3767 - RNA, 18 nt, Artificial Sequence
  Synthetic
auuaaguccagauuuauc

SEQ ID NO: 3768 - RNA, 19 nt, Artificial Sequence
  Synthetic
gauuaaguccagauuuauc

SEQ ID NO: 3769 - RNA, 20 nt, Artificial Sequence
  Synthetic
ugauuaaguccagauuuauc

SEQ ID NO: 3770 - RNA, 21 nt, Artificial Sequence
  Synthetic
uugauuaaguccagauuuauc

SEQ ID NO: 3771 - RNA, 22 nt, Artificial Sequence
  Synthetic
uuugauuaaguccagauuuauc

SEQ ID NO: 3772 - RNA, 23 nt, Artificial Sequence
  Synthetic
uuuugauuaaguccagauuuauc

SEQ ID NO: 3773 - RNA, 24 nt, Artificial Sequence
  Synthetic
auuuugauuaaguccagauuuauc

SEQ ID NO: 3774 - RNA, 18 nt, Artificial Sequence
  Synthetic
ucauuaccuuguggucuc

SEQ ID NO: 3775 - RNA, 19 nt, Artificial Sequence
  Synthetic
uucauuaccuuguggucuc

SEQ ID NO: 3776 - RNA, 20 nt, Artificial Sequence
  Synthetic
uuucauuaccuuguggucuc

SEQ ID NO: 3777 - RNA, 21 nt, Artificial Sequence
  Synthetic
uuuucauuaccuuguggucuc

SEQ ID NO: 3778 - RNA, 22 nt, Artificial Sequence
  Synthetic
uuuuucauuaccuuguggucuc

SEQ ID NO: 3779 - RNA, 23 nt, Artificial Sequence
  Synthetic
auuuuucauuaccuuguggucuc

SEQ ID NO: 3780 - RNA, 24 nt, Artificial Sequence
  Synthetic
uauuuuucauuaccuuguggucuc

SEQ ID NO: 3781 - RNA, 18 nt, Artificial Sequence
  Synthetic
ugaaauuucuguauuuuc

SEQ ID NO: 3782 - RNA, 19 nt, Artificial Sequence
  Synthetic
cugaaauuucuguauuuuc

SEQ ID NO: 3783 - RNA, 20 nt, Artificial Sequence
  Synthetic
ucugaaauuucuguauuuuc

SEQ ID NO: 3784 - RNA, 21 nt, Artificial Sequence
  Synthetic
uucugaaauuucuguauuuuc

SEQ ID NO: 3785 - RNA, 22 nt, Artificial Sequence
  Synthetic
uuucugaaauuucuguauuuuc

SEQ ID NO: 3786 - RNA, 23 nt, Artificial Sequence
  Synthetic
auuucugaaauuucuguauuuuc

SEQ ID NO: 3787 - RNA, 24 nt, Artificial Sequence
  Synthetic
uauuucugaaauuucuguauuuuc

SEQ ID NO: 3788 - RNA, 18 nt, Artificial Sequence
  Synthetic
auuuuaauacugcaacag

SEQ ID NO: 3789 - RNA, 19 nt, Artificial Sequence
  Synthetic
cauuuuaauacugcaacag

SEQ ID NO: 3790 - RNA, 20 nt, Artificial Sequence
  Synthetic
ccauuuuaauacugcaacag

SEQ ID NO: 3791 - RNA, 21 nt, Artificial Sequence
  Synthetic
accauuuuaauacugcaacag

SEQ ID NO: 3792 - RNA, 22 nt, Artificial Sequence
  Synthetic
caccauuuuaauacugcaacag

SEQ ID NO: 3793 - RNA, 23 nt, Artificial Sequence
  Synthetic
ucaccauuuuaauacugcaacag

SEQ ID NO: 3794 - RNA, 24 nt, Artificial Sequence
  Synthetic
cucaccauuuuaauacugcaacag

SEQ ID NO: 3795 - RNA, 18 nt, Artificial Sequence
  Synthetic
gagaacucaguuuuuagg

SEQ ID NO: 3796 - RNA, 19 nt, Artificial Sequence
  Synthetic
agagaacucaguuuuuagg

SEQ ID NO: 3797 - RNA, 20 nt, Artificial Sequence
  Synthetic
uagagaacucaguuuuuagg

SEQ ID NO: 3798 - RNA, 21 nt, Artificial Sequence
  Synthetic
uuagagaacucaguuuuuagg

SEQ ID NO: 3799 - RNA, 22 nt, Artificial Sequence
  Synthetic
uuuagagaacucaguuuuuagg

SEQ ID NO: 3800 - RNA, 23 nt, Artificial Sequence
  Synthetic
uuuuagagaacucaguuuuuagg

SEQ ID NO: 3801 - RNA, 24 nt, Artificial Sequence
  Synthetic
uuuuuagagaacucaguuuuuagg

SEQ ID NO: 3802 - RNA, 18 nt, Artificial Sequence
  Synthetic
uagguugggaaagacugg

SEQ ID NO: 3803 - RNA, 19 nt, Artificial Sequence
  Synthetic
uuagguugggaaagacugg

SEQ ID NO: 3804 - RNA, 20 nt, Artificial Sequence
  Synthetic
uuuagguugggaaagacugg

SEQ ID NO: 3805 - RNA, 21 nt, Artificial Sequence
  Synthetic
uuuuagguugggaaagacugg

SEQ ID NO: 3806 - RNA, 22 nt, Artificial Sequence
  Synthetic
uuuuuagguugggaaagacugg

SEQ ID NO: 3807 - RNA, 23 nt, Artificial Sequence
  Synthetic
guuuuuagguugggaaagacugg

SEQ ID NO: 3808 - RNA, 24 nt, Artificial Sequence
  Synthetic
aguuuuuagguugggaaagacugg

SEQ ID NO: 3809 - RNA, 18 nt, Artificial Sequence
  Synthetic
uucaagagacuacaaaug

SEQ ID NO: 3810 - RNA, 19 nt, Artificial Sequence
  Synthetic
uuucaagagacuacaaaug

SEQ ID NO: 3811 - RNA, 20 nt, Artificial Sequence
  Synthetic
uuuucaagagacuacaaaug

SEQ ID NO: 3812 - RNA, 21 nt, Artificial Sequence
  Synthetic
auuuucaagagacuacaaaug

SEQ ID NO: 3813 - RNA, 22 nt, Artificial Sequence
  Synthetic
uauuuucaagagacuacaaaug

SEQ ID NO: 3814 - RNA, 23 nt, Artificial Sequence
  Synthetic
guauuuucaagagacuacaaaug

SEQ ID NO: 3815 - RNA, 24 nt, Artificial Sequence
  Synthetic
uguauuuucaagagacuacaaaug

SEQ ID NO: 3816 - RNA, 18 nt, Artificial Sequence
  Synthetic
guugggaaagacuggaug

SEQ ID NO: 3817 - RNA, 19 nt, Artificial Sequence
  Synthetic
gguugggaaagacuggaug

SEQ ID NO: 3818 - RNA, 20 nt, Artificial Sequence
  Synthetic
agguugggaaagacuggaug

SEQ ID NO: 3819 - RNA, 21 nt, Artificial Sequence
  Synthetic
uagguugggaaagacuggaug

SEQ ID NO: 3820 - RNA, 22 nt, Artificial Sequence
  Synthetic
uuagguugggaaagacuggaug

SEQ ID NO: 3821 - RNA, 23 nt, Artificial Sequence
  Synthetic
uuuagguugggaaagacuggaug

SEQ ID NO: 3822 - RNA, 24 nt, Artificial Sequence
  Synthetic
uuuuagguugggaaagacuggaug

SEQ ID NO: 3823 - RNA, 18 nt, Artificial Sequence
  Synthetic
auaaaucaaaauaauaug

SEQ ID NO: 3824 - RNA, 19 nt, Artificial Sequence
  Synthetic
gauaaaucaaaauaauaug

SEQ ID NO: 3825 - RNA, 20 nt, Artificial Sequence
  Synthetic
agauaaaucaaaauaauaug

SEQ ID NO: 3826 - RNA, 21 nt, Artificial Sequence
  Synthetic
aagauaaaucaaaauaauaug

SEQ ID NO: 3827 - RNA, 22 nt, Artificial Sequence
  Synthetic
caagauaaaucaaaauaauaug

SEQ ID NO: 3828 - RNA, 23 nt, Artificial Sequence
  Synthetic
ucaagauaaaucaaaauaauaug

SEQ ID NO: 3829 - RNA, 24 nt, Artificial Sequence
  Synthetic
aucaagauaaaucaaaauaauaug

SEQ ID NO: 3830 - RNA, 18 nt, Artificial Sequence
  Synthetic
aucaaauaucuauuuaau

SEQ ID NO: 3831 - RNA, 19 nt, Artificial Sequence
  Synthetic
uaucaaauaucuauuuaau

SEQ ID NO: 3832 - RNA, 20 nt, Artificial Sequence
  Synthetic
cuaucaaauaucuauuuaau

SEQ ID NO: 3833 - RNA, 21 nt, Artificial Sequence
  Synthetic
acuaucaaauaucuauuuaau

SEQ ID NO: 3834 - RNA, 22 nt, Artificial Sequence
  Synthetic
uacuaucaaauaucuauuuaau

SEQ ID NO: 3835 - RNA, 23 nt, Artificial Sequence
  Synthetic
guacuaucaaauaucuauuuaau

SEQ ID NO: 3836 - RNA, 24 nt, Artificial Sequence
  Synthetic
aguacuaucaaauaucuauuuaau

SEQ ID NO: 3837 - RNA, 18 nt, Artificial Sequence
  Synthetic
auauauacaauauaccau

SEQ ID NO: 3838 - RNA, 19 nt, Artificial Sequence
  Synthetic
gauauauacaauauaccau

SEQ ID NO: 3839 - RNA, 20 nt, Artificial Sequence
  Synthetic
ugauauauacaauauaccau

SEQ ID NO: 3840 - RNA, 21 nt, Artificial Sequence
  Synthetic
gugauauauacaauauaccau

SEQ ID NO: 3841 - RNA, 22 nt, Artificial Sequence
  Synthetic
ugugauauauacaauauaccau

SEQ ID NO: 3842 - RNA, 23 nt, Artificial Sequence
  Synthetic
cugugauauauacaauauaccau

SEQ ID NO: 3843 - RNA, 24 nt, Artificial Sequence
  Synthetic
acugugauauauacaauauaccau

SEQ ID NO: 3844 - RNA, 18 nt, Artificial Sequence
  Synthetic
auauacaauauaccauau

SEQ ID NO: 3845 - RNA, 19 nt, Artificial Sequence
  Synthetic
uauauacaauauaccauau

SEQ ID NO: 3846 - RNA, 20 nt, Artificial Sequence
  Synthetic
auauauacaauauaccauau

SEQ ID NO: 3847 - RNA, 21 nt, Artificial Sequence
  Synthetic
gauauauacaauauaccauau

SEQ ID NO: 3848 - RNA, 22 nt, Artificial Sequence
  Synthetic
ugauauauacaauauaccauau

SEQ ID NO: 3849 - RNA, 23 nt, Artificial Sequence
  Synthetic
gugauauauacaauauaccauau

SEQ ID NO: 3850 - RNA, 24 nt, Artificial Sequence
  Synthetic
ugugauauauacaauauaccauau

SEQ ID NO: 3851 - RNA, 18 nt, Artificial Sequence
  Synthetic
agaacucaguuuuuaggu

SEQ ID NO: 3852 - RNA, 19 nt, Artificial Sequence
  Synthetic
gagaacucaguuuuuaggu

SEQ ID NO: 3853 - RNA, 21 nt, Artificial Sequence
  Synthetic
uagagaacucaguuuuuaggu

SEQ ID NO: 3854 - RNA, 22 nt, Artificial Sequence
  Synthetic
uuagagaacucaguuuuuaggu

SEQ ID NO: 3855 - RNA, 23 nt, Artificial Sequence
  Synthetic
uuuagagaacucaguuuuuaggu

SEQ ID NO: 3856 - RNA, 24 nt, Artificial Sequence
  Synthetic
uuuuagagaacucaguuuuuaggu

SEQ ID NO: 3857 - RNA, 18 nt, Artificial Sequence
  Synthetic
gaacucaguuuuuagguu

SEQ ID NO: 3858 - RNA, 19 nt, Artificial Sequence
  Synthetic
agaacucaguuuuuagguu

SEQ ID NO: 3859 - RNA, 21 nt, Artificial Sequence
  Synthetic
agagaacucaguuuuuagguu

SEQ ID NO: 3860 - RNA, 22 nt, Artificial Sequence
  Synthetic
uagagaacucaguuuuuagguu

SEQ ID NO: 3861 - RNA, 23 nt, Artificial Sequence
  Synthetic
uuagagaacucaguuuuuagguu

SEQ ID NO: 3862 - RNA, 24 nt, Artificial Sequence
  Synthetic
uuuagagaacucaguuuuuagguu

SEQ ID NO: 3863 - RNA, 18 nt, Artificial Sequence
  Synthetic
uauucuuauaaauuauuu

SEQ ID NO: 3864 - RNA, 19 nt, Artificial Sequence
  Synthetic
auauucuuauaaauuauuu

SEQ ID NO: 3865 - RNA, 20 nt, Artificial Sequence
  Synthetic
gauauucuuauaaauuauuu

SEQ ID NO: 3866 - RNA, 21 nt, Artificial Sequence
  Synthetic
ugauauucuuauaaauuauuu

SEQ ID NO: 3867 - RNA, 22 nt, Artificial Sequence
  Synthetic
uugauauucuuauaaauuauuu

SEQ ID NO: 3868 - RNA, 23 nt, Artificial Sequence
  Synthetic
cuugauauucuuauaaauuauuu

SEQ ID NO: 3869 - RNA, 24 nt, Artificial Sequence
  Synthetic
ccuugauauucuuauaaauuauuu

SEQ ID NO: 3870 - RNA, 18 nt, Artificial Sequence
  Synthetic
gcacauaauaauuaguuu

SEQ ID NO: 3871 - RNA, 19 nt, Artificial Sequence
  Synthetic
ggcacauaauaauuaguuu

SEQ ID NO: 3872 - RNA, 20 nt, Artificial Sequence
  Synthetic
uggcacauaauaauuaguuu

SEQ ID NO: 3873 - RNA, 21 nt, Artificial Sequence
  Synthetic
cuggcacauaauaauuaguuu

SEQ ID NO: 3874 - RNA, 22 nt, Artificial Sequence
  Synthetic
acuggcacauaauaauuaguuu

SEQ ID NO: 3875 - RNA, 23 nt, Artificial Sequence
  Synthetic
aacuggcacauaauaauuaguuu

SEQ ID NO: 3876 - RNA, 24 nt, Artificial Sequence
  Synthetic
uaacuggcacauaauaauuaguuu

SEQ ID NO: 3877 - RNA, 18 nt, Artificial Sequence
  Synthetic
aaaaaauacuaaaauuuu

SEQ ID NO: 3878 - RNA, 19 nt, Artificial Sequence
  Synthetic
aaaaaaauacuaaaauuuu

SEQ ID NO: 3879 - RNA, 20 nt, Artificial Sequence
  Synthetic
gaaaaaaauacuaaaauuuu

SEQ ID NO: 3880 - RNA, 21 nt, Artificial Sequence
  Synthetic
agaaaaaaauacuaaaauuuu

SEQ ID NO: 3881 - RNA, 22 nt, Artificial Sequence
  Synthetic
cagaaaaaaauacuaaaauuuu

SEQ ID NO: 3882 - RNA, 23 nt, Artificial Sequence
  Synthetic
ucagaaaaaaauacuaaaauuuu

SEQ ID NO: 3883 - RNA, 24 nt, Artificial Sequence
  Synthetic
uucagaaaaaaauacuaaaauuuu

SEQ ID NO: 3884 - RNA, 18 nt, Artificial Sequence
  Synthetic
auuuuuuucugaagaaaa

SEQ ID NO: 3885 - RNA, 19 nt, Artificial Sequence
  Synthetic
uauuuuuuucugaagaaaa

SEQ ID NO: 3886 - RNA, 21 nt, Artificial Sequence
  Synthetic
aguauuuuuuucugaagaaaa

SEQ ID NO: 3887 - RNA, 22 nt, Artificial Sequence
  Synthetic
uaguauuuuuuucugaagaaaa

SEQ ID NO: 3888 - RNA, 23 nt, Artificial Sequence
  Synthetic
uuaguauuuuuuucugaagaaaa

SEQ ID NO: 3889 - RNA, 24 nt, Artificial Sequence
  Synthetic
uuuaguauuuuuuucugaagaaaa

SEQ ID NO: 3890 - RNA, 18 nt, Artificial Sequence
  Synthetic
uauuuuuuucugaagaaa

SEQ ID NO: 3891 - RNA, 19 nt, Artificial Sequence
  Synthetic
guauuuuuuucugaagaaa

SEQ ID NO: 3892 - RNA, 21 nt, Artificial Sequence
  Synthetic
uaguauuuuuuucugaagaaa

SEQ ID NO: 3893 - RNA, 22 nt, Artificial Sequence
  Synthetic
uuaguauuuuuuucugaagaaa

SEQ ID NO: 3894 - RNA, 23 nt, Artificial Sequence
  Synthetic
uuuaguauuuuuuucugaagaaa

SEQ ID NO: 3895 - RNA, 24 nt, Artificial Sequence
  Synthetic
uuuuaguauuuuuuucugaagaaa

SEQ ID NO: 3896 - RNA, 18 nt, Artificial Sequence
  Synthetic
guauuuuuuucugaagaa

SEQ ID NO: 3897 - RNA, 19 nt, Artificial Sequence
  Synthetic
aguauuuuuuucugaagaa

SEQ ID NO: 3898 - RNA, 20 nt, Artificial Sequence
  Synthetic
uaguauuuuuuucugaagaa

SEQ ID NO: 3899 - RNA, 21 nt, Artificial Sequence
  Synthetic
uuaguauuuuuuucugaagaa

SEQ ID NO: 3900 - RNA, 22 nt, Artificial Sequence
  Synthetic
uuuaguauuuuuuucugaagaa

SEQ ID NO: 3901 - RNA, 23 nt, Artificial Sequence
  Synthetic
uuuuaguauuuuuuucugaagaa

SEQ ID NO: 3902 - RNA, 24 nt, Artificial Sequence
  Synthetic
auuuuaguauuuuuuucugaagaa

SEQ ID NO: 3903 - RNA, 18 nt, Artificial Sequence
  Synthetic
ugaguaagacacccugaa

SEQ ID NO: 3904 - RNA, 19 nt, Artificial Sequence
  Synthetic
gugaguaagacacccugaa

SEQ ID NO: 3905 - RNA, 21 nt, Artificial Sequence
  Synthetic
uggugaguaagacacccugaa

SEQ ID NO: 3906 - RNA, 22 nt, Artificial Sequence
  Synthetic
auggugaguaagacacccugaa

SEQ ID NO: 3907 - RNA, 23 nt, Artificial Sequence
  Synthetic
aauggugaguaagacacccugaa

SEQ ID NO: 3908 - RNA, 24 nt, Artificial Sequence
  Synthetic
aaauggugaguaagacacccugaa

SEQ ID NO: 3909 - RNA, 18 nt, Artificial Sequence
  Synthetic
uguuucauuaauaauuaa

SEQ ID NO: 3910 - RNA, 19 nt, Artificial Sequence
  Synthetic
auguuucauuaauaauuaa

SEQ ID NO: 3911 - RNA, 20 nt, Artificial Sequence
  Synthetic
uauguuucauuaauaauuaa

SEQ ID NO: 3912 - RNA, 21 nt, Artificial Sequence
  Synthetic
cuauguuucauuaauaauuaa

SEQ ID NO: 3913 - RNA, 22 nt, Artificial Sequence
  Synthetic
acuauguuucauuaauaauuaa

SEQ ID NO: 3914 - RNA, 23 nt, Artificial Sequence
  Synthetic
uacuauguuucauuaauaauuaa

SEQ ID NO: 3915 - RNA, 24 nt, Artificial Sequence
  Synthetic
auacuauguuucauuaauaauuaa

SEQ ID NO: 3916 - RNA, 18 nt, Artificial Sequence
  Synthetic
ucucagggaggaggugca

SEQ ID NO: 3917 - RNA, 19 nt, Artificial Sequence
  Synthetic
uucucagggaggaggugca

SEQ ID NO: 3918 - RNA, 20 nt, Artificial Sequence
  Synthetic
auucucagggaggaggugca

SEQ ID NO: 3919 - RNA, 21 nt, Artificial Sequence
  Synthetic
cauucucagggaggaggugca

SEQ ID NO: 3920 - RNA, 22 nt, Artificial Sequence
  Synthetic
acauucucagggaggaggugca

SEQ ID NO: 3921 - RNA, 23 nt, Artificial Sequence
  Synthetic
aacauucucagggaggaggugca

SEQ ID NO: 3922 - RNA, 24 nt, Artificial Sequence
  Synthetic
caacauucucagggaggaggugca

SEQ ID NO: 3923 - RNA, 18 nt, Artificial Sequence
  Synthetic
gccuuauucaacagauca

SEQ ID NO: 3924 - RNA, 19 nt, Artificial Sequence
  Synthetic
agccuuauucaacagauca

SEQ ID NO: 3925 - RNA, 20 nt, Artificial Sequence
  Synthetic
uagccuuauucaacagauca

SEQ ID NO: 3926 - RNA, 21 nt, Artificial Sequence
  Synthetic
cuagccuuauucaacagauca

SEQ ID NO: 3927 - RNA, 22 nt, Artificial Sequence
  Synthetic
ucuagccuuauucaacagauca

SEQ ID NO: 3928 - RNA, 23 nt, Artificial Sequence
  Synthetic
cucuagccuuauucaacagauca

SEQ ID NO: 3929 - RNA, 24 nt, Artificial Sequence
  Synthetic
acucuagccuuauucaacagauca

SEQ ID NO: 3930 - RNA, 18 nt, Artificial Sequence
  Synthetic
cuugauccaacauucuca

SEQ ID NO: 3931 - RNA, 19 nt, Artificial Sequence
  Synthetic
ucuugauccaacauucuca

SEQ ID NO: 3932 - RNA, 21 nt, Artificial Sequence
  Synthetic
uaucuugauccaacauucuca

SEQ ID NO: 3933 - RNA, 22 nt, Artificial Sequence
  Synthetic
uuaucuugauccaacauucuca

SEQ ID NO: 3934 - RNA, 23 nt, Artificial Sequence
  Synthetic
uuuaucuugauccaacauucuca

SEQ ID NO: 3935 - RNA, 24 nt, Artificial Sequence
  Synthetic
auuuaucuugauccaacauucuca

SEQ ID NO: 3936 - RNA, 18 nt, Artificial Sequence
  Synthetic
gugaguaagacacccuga

SEQ ID NO: 3937 - RNA, 19 nt, Artificial Sequence
  Synthetic
ggugaguaagacacccuga

SEQ ID NO: 3938 - RNA, 20 nt, Artificial Sequence
  Synthetic
uggugaguaagacacccuga

SEQ ID NO: 3939 - RNA, 21 nt, Artificial Sequence
  Synthetic
auggugaguaagacacccuga

SEQ ID NO: 3940 - RNA, 22 nt, Artificial Sequence
  Synthetic
aauggugaguaagacacccuga

SEQ ID NO: 3941 - RNA, 23 nt, Artificial Sequence
  Synthetic
aaauggugaguaagacacccuga

SEQ ID NO: 3942 - RNA, 24 nt, Artificial Sequence
  Synthetic
aaaauggugaguaagacacccuga

SEQ ID NO: 3943 - RNA, 18 nt, Artificial Sequence
  Synthetic
uguagucucuugaaaaua

SEQ ID NO: 3944 - RNA, 19 nt, Artificial Sequence
  Synthetic
uuguagucucuugaaaaua

SEQ ID NO: 3945 - RNA, 20 nt, Artificial Sequence
  Synthetic
uuuguagucucuugaaaaua

SEQ ID NO: 3946 - RNA, 21 nt, Artificial Sequence
  Synthetic
auuuguagucucuugaaaaua

SEQ ID NO: 3947 - RNA, 22 nt, Artificial Sequence
  Synthetic
cauuuguagucucuugaaaaua

SEQ ID NO: 3948 - RNA, 23 nt, Artificial Sequence
  Synthetic
ccauuuguagucucuugaaaaua

SEQ ID NO: 3949 - RNA, 24 nt, Artificial Sequence
  Synthetic
uccauuuguagucucuugaaaaua

SEQ ID NO: 3950 - RNA, 18 nt, Artificial Sequence
  Synthetic
cagcaguucaaugauaua

SEQ ID NO: 3951 - RNA, 19 nt, Artificial Sequence
  Synthetic
ccagcaguucaaugauaua

SEQ ID NO: 3952 - RNA, 21 nt, Artificial Sequence
  Synthetic
uaccagcaguucaaugauaua

SEQ ID NO: 3953 - RNA, 22 nt, Artificial Sequence
  Synthetic
uuaccagcaguucaaugauaua

SEQ ID NO: 3954 - RNA, 23 nt, Artificial Sequence
  Synthetic
auuaccagcaguucaaugauaua

SEQ ID NO: 3955 - RNA, 24 nt, Artificial Sequence
  Synthetic
cauuaccagcaguucaaugauaua

SEQ ID NO: 3956 - RNA, 18 nt, Artificial Sequence
  Synthetic
ucuggagaccacaaggua

SEQ ID NO: 3957 - RNA, 19 nt, Artificial Sequence
  Synthetic
uucuggagaccacaaggua

SEQ ID NO: 3958 - RNA, 20 nt, Artificial Sequence
  Synthetic
uuucuggagaccacaaggua

SEQ ID NO: 3959 - RNA, 21 nt, Artificial Sequence
  Synthetic
auuucuggagaccacaaggua

SEQ ID NO: 3960 - RNA, 22 nt, Artificial Sequence
  Synthetic
gauuucuggagaccacaaggua

SEQ ID NO: 3961 - RNA, 23 nt, Artificial Sequence
  Synthetic
ugauuucuggagaccacaaggua

SEQ ID NO: 3962 - RNA, 24 nt, Artificial Sequence
  Synthetic
uugauuucuggagaccacaaggua

SEQ ID NO: 3963 - RNA, 18 nt, Artificial Sequence
  Synthetic
ugugccaguuauauaaac

SEQ ID NO: 3964 - RNA, 19 nt, Artificial Sequence
  Synthetic
augugccaguuauauaaac

SEQ ID NO: 3965 - RNA, 20 nt, Artificial Sequence
  Synthetic
uaugugccaguuauauaaac

SEQ ID NO: 3966 - RNA, 21 nt, Artificial Sequence
  Synthetic
uuaugugccaguuauauaaac

SEQ ID NO: 3967 - RNA, 22 nt, Artificial Sequence
  Synthetic
auuaugugccaguuauauaaac

SEQ ID NO: 3968 - RNA, 23 nt, Artificial Sequence
  Synthetic
uauuaugugccaguuauauaaac

SEQ ID NO: 3969 - RNA, 24 nt, Artificial Sequence
  Synthetic
uuauuaugugccaguuauauaaac

SEQ ID NO: 3970 - RNA, 18 nt, Artificial Sequence
  Synthetic
aauggugaguaagacacc

SEQ ID NO: 3971 - RNA, 19 nt, Artificial Sequence
  Synthetic
aaauggugaguaagacacc

SEQ ID NO: 3972 - RNA, 20 nt, Artificial Sequence
  Synthetic
aaaauggugaguaagacacc

SEQ ID NO: 3973 - RNA, 21 nt, Artificial Sequence
  Synthetic
uaaaauggugaguaagacacc

SEQ ID NO: 3974 - RNA, 22 nt, Artificial Sequence
  Synthetic
uuaaaauggugaguaagacacc

SEQ ID NO: 3975 - RNA, 23 nt, Artificial Sequence
  Synthetic
auuaaaauggugaguaagacacc

SEQ ID NO: 3976 - RNA, 24 nt, Artificial Sequence
  Synthetic
uauuaaaauggugaguaagacacc

SEQ ID NO: 3977 - RNA, 18 nt, Artificial Sequence
  Synthetic
acagaucacugagaagcc

SEQ ID NO: 3978 - RNA, 19 nt, Artificial Sequence
  Synthetic
aacagaucacugagaagcc

SEQ ID NO: 3979 - RNA, 21 nt, Artificial Sequence
  Synthetic
ucaacagaucacugagaagcc

SEQ ID NO: 3980 - RNA, 22 nt, Artificial Sequence
  Synthetic
uucaacagaucacugagaagcc

SEQ ID NO: 3981 - RNA, 23 nt, Artificial Sequence
  Synthetic
auucaacagaucacugagaagcc

SEQ ID NO: 3982 - RNA, 24 nt, Artificial Sequence
  Synthetic
uauucaacagaucacugagaagcc

SEQ ID NO: 3983 - RNA, 18 nt, Artificial Sequence
  Synthetic
gccuggaaaaacaaaucc

SEQ ID NO: 3984 - RNA, 19 nt, Artificial Sequence
  Synthetic
agccuggaaaaacaaaucc

SEQ ID NO: 3985 - RNA, 21 nt, Artificial Sequence
  Synthetic
gaagccuggaaaaacaaaucc

SEQ ID NO: 3986 - RNA, 22 nt, Artificial Sequence
  Synthetic
agaagccuggaaaaacaaaucc

SEQ ID NO: 3987 - RNA, 23 nt, Artificial Sequence
  Synthetic
gagaagccuggaaaaacaaaucc

SEQ ID NO: 3988 - RNA, 24 nt, Artificial Sequence
  Synthetic
ugagaagccuggaaaaacaaaucc

SEQ ID NO: 3989 - RNA, 18 nt, Artificial Sequence
  Synthetic
aacagaucacugagaagc

SEQ ID NO: 3990 - RNA, 19 nt, Artificial Sequence
  Synthetic
caacagaucacugagaagc

SEQ ID NO: 3991 - RNA, 20 nt, Artificial Sequence
  Synthetic
ucaacagaucacugagaagc

SEQ ID NO: 3992 - RNA, 21 nt, Artificial Sequence
  Synthetic
uucaacagaucacugagaagc

SEQ ID NO: 3993 - RNA, 22 nt, Artificial Sequence
  Synthetic
auucaacagaucacugagaagc

SEQ ID NO: 3994 - RNA, 23 nt, Artificial Sequence
  Synthetic
uauucaacagaucacugagaagc

SEQ ID NO: 3995 - RNA, 24 nt, Artificial Sequence
  Synthetic
uuauucaacagaucacugagaagc

SEQ ID NO: 3996 - RNA, 18 nt, Artificial Sequence
  Synthetic
ucuuaaaagcuuauuugc

SEQ ID NO: 3997 - RNA, 19 nt, Artificial Sequence
  Synthetic
gucuuaaaagcuuauuugc

SEQ ID NO: 3998 - RNA, 21 nt, Artificial Sequence
  Synthetic
augucuuaaaagcuuauuugc

SEQ ID NO: 3999 - RNA, 22 nt, Artificial Sequence
  Synthetic
uaugucuuaaaagcuuauuugc

SEQ ID NO: 4000 - RNA, 23 nt, Artificial Sequence
  Synthetic
guaugucuuaaaagcuuauuugc

SEQ ID NO: 4001 - RNA, 24 nt, Artificial Sequence
  Synthetic
gguaugucuuaaaagcuuauuugc

SEQ ID NO: 4002 - RNA, 18 nt, Artificial Sequence
  Synthetic
agccuggaaaaacaaauc

SEQ ID NO: 4003 - RNA, 19 nt, Artificial Sequence
  Synthetic
aagccuggaaaaacaaauc

SEQ ID NO: 4004 - RNA, 20 nt, Artificial Sequence
  Synthetic
gaagccuggaaaaacaaauc

SEQ ID NO: 4005 - RNA, 21 nt, Artificial Sequence
  Synthetic
agaagccuggaaaaacaaauc

SEQ ID NO: 4006 - RNA, 22 nt, Artificial Sequence
  Synthetic
gagaagccuggaaaaacaaauc

SEQ ID NO: 4007 - RNA, 23 nt, Artificial Sequence
  Synthetic
ugagaagccuggaaaaacaaauc

SEQ ID NO: 4008 - RNA, 24 nt, Artificial Sequence
  Synthetic
cugagaagccuggaaaaacaaauc

SEQ ID NO: 4009 - RNA, 18 nt, Artificial Sequence
  Synthetic
uucuccauuuguagucuc

SEQ ID NO: 4010 - RNA, 19 nt, Artificial Sequence
  Synthetic
uuucuccauuuguagucuc

SEQ ID NO: 4011 - RNA, 20 nt, Artificial Sequence
  Synthetic
cuuucuccauuuguagucuc

SEQ ID NO: 4012 - RNA, 21 nt, Artificial Sequence
  Synthetic
gcuuucuccauuuguagucuc

SEQ ID NO: 4013 - RNA, 22 nt, Artificial Sequence
  Synthetic
ugcuuucuccauuuguagucuc

SEQ ID NO: 4014 - RNA, 23 nt, Artificial Sequence
  Synthetic
cugcuuucuccauuuguagucuc

SEQ ID NO: 4015 - RNA, 24 nt, Artificial Sequence
  Synthetic
acugcuuucuccauuuguagucuc

SEQ ID NO: 4016 - RNA, 18 nt, Artificial Sequence
  Synthetic
ucuugauccaacauucuc

SEQ ID NO: 4017 - RNA, 19 nt, Artificial Sequence
  Synthetic
aucuugauccaacauucuc

SEQ ID NO: 4018 - RNA, 21 nt, Artificial Sequence
  Synthetic
uuaucuugauccaacauucuc

SEQ ID NO: 4019 - RNA, 22 nt, Artificial Sequence
  Synthetic
uuuaucuugauccaacauucuc

SEQ ID NO: 4020 - RNA, 23 nt, Artificial Sequence
  Synthetic
auuuaucuugauccaacauucuc

SEQ ID NO: 4021 - RNA, 24 nt, Artificial Sequence
  Synthetic
gauuuaucuugauccaacauucuc

SEQ ID NO: 4022 - RNA, 18 nt, Artificial Sequence
  Synthetic
acuugucaucuugauuuc

SEQ ID NO: 4023 - RNA, 19 nt, Artificial Sequence
  Synthetic
gacuugucaucuugauuuc

SEQ ID NO: 4024 - RNA, 21 nt, Artificial Sequence
  Synthetic
uugacuugucaucuugauuuc

SEQ ID NO: 4025 - RNA, 22 nt, Artificial Sequence
  Synthetic
guugacuugucaucuugauuuc

SEQ ID NO: 4026 - RNA, 23 nt, Artificial Sequence
  Synthetic
aguugacuugucaucuugauuuc

SEQ ID NO: 4027 - RNA, 24 nt, Artificial Sequence
  Synthetic
caguugacuugucaucuugauuuc

SEQ ID NO: 4028 - RNA, 18 nt, Artificial Sequence
  Synthetic
uuuuuuucugaagaaaag

SEQ ID NO: 4029 - RNA, 19 nt, Artificial Sequence
  Synthetic
auuuuuuucugaagaaaag

SEQ ID NO: 4030 - RNA, 21 nt, Artificial Sequence
  Synthetic
guauuuuuuucugaagaaaag

SEQ ID NO: 4031 - RNA, 22 nt, Artificial Sequence
  Synthetic
aguauuuuuuucugaagaaaag

SEQ ID NO: 4032 - RNA, 23 nt, Artificial Sequence
  Synthetic
uaguauuuuuuucugaagaaaag

SEQ ID NO: 4033 - RNA, 24 nt, Artificial Sequence
  Synthetic
uuaguauuuuuuucugaagaaaag

SEQ ID NO: 4034 - RNA, 18 nt, Artificial Sequence
  Synthetic
ugauccaacauucucagg

SEQ ID NO: 4035 - RNA, 19 nt, Artificial Sequence
  Synthetic
uugauccaacauucucagg

SEQ ID NO: 4036 - RNA, 20 nt, Artificial Sequence
  Synthetic
cuugauccaacauucucagg

SEQ ID NO: 4037 - RNA, 21 nt, Artificial Sequence
  Synthetic
ucuugauccaacauucucagg

SEQ ID NO: 4038 - RNA, 22 nt, Artificial Sequence
  Synthetic
aucuugauccaacauucucagg

SEQ ID NO: 4039 - RNA, 23 nt, Artificial Sequence
  Synthetic
uaucuugauccaacauucucagg

SEQ ID NO: 4040 - RNA, 24 nt, Artificial Sequence
  Synthetic
uuaucuugauccaacauucucagg

SEQ ID NO: 4041 - RNA, 18 nt, Artificial Sequence
  Synthetic
gauccaacauucucaggg

SEQ ID NO: 4042 - RNA, 19 nt, Artificial Sequence
  Synthetic
ugauccaacauucucaggg

SEQ ID NO: 4043 - RNA, 21 nt, Artificial Sequence
  Synthetic
cuugauccaacauucucaggg

SEQ ID NO: 4044 - RNA, 22 nt, Artificial Sequence
  Synthetic
ucuugauccaacauucucaggg

SEQ ID NO: 4045 - RNA, 23 nt, Artificial Sequence
  Synthetic
aucuugauccaacauucucaggg

SEQ ID NO: 4046 - RNA, 24 nt, Artificial Sequence
  Synthetic
uaucuugauccaacauucucaggg

SEQ ID NO: 4047 - RNA, 18 nt, Artificial Sequence
  Synthetic
uaaggucuauacuuuugg

SEQ ID NO: 4048 - RNA, 19 nt, Artificial Sequence
  Synthetic
uuaaggucuauacuuuugg

SEQ ID NO: 4049 - RNA, 20 nt, Artificial Sequence
  Synthetic
uuuaaggucuauacuuuugg

SEQ ID NO: 4050 - RNA, 21 nt, Artificial Sequence
  Synthetic
cuuuaaggucuauacuuuugg

SEQ ID NO: 4051 - RNA, 22 nt, Artificial Sequence
  Synthetic
acuuuaaggucuauacuuuugg

SEQ ID NO: 4052 - RNA, 23 nt, Artificial Sequence
  Synthetic
uacuuuaaggucuauacuuuugg

SEQ ID NO: 4053 - RNA, 24 nt, Artificial Sequence
  Synthetic
guacuuuaaggucuauacuuuugg

SEQ ID NO: 4054 - RNA, 18 nt, Artificial Sequence
  Synthetic
uuuuaguauuuuuuucug

SEQ ID NO: 4055 - RNA, 19 nt, Artificial Sequence
  Synthetic
auuuuaguauuuuuuucug

SEQ ID NO: 4056 - RNA, 20 nt, Artificial Sequence
  Synthetic
aauuuuaguauuuuuuucug

SEQ ID NO: 4057 - RNA, 21 nt, Artificial Sequence
  Synthetic
aaauuuuaguauuuuuuucug

SEQ ID NO: 4058 - RNA, 22 nt, Artificial Sequence
  Synthetic
aaaauuuuaguauuuuuuucug

SEQ ID NO: 4059 - RNA, 23 nt, Artificial Sequence
  Synthetic
aaaaauuuuaguauuuuuuucug

SEQ ID NO: 4060 - RNA, 24 nt, Artificial Sequence
  Synthetic
uaaaaauuuuaguauuuuuuucug

SEQ ID NO: 4061 - RNA, 18 nt, Artificial Sequence
  Synthetic
gucuuaaaagcuuauuug

SEQ ID NO: 4062 - RNA, 19 nt, Artificial Sequence
  Synthetic
ugucuuaaaagcuuauuug

SEQ ID NO: 4063 - RNA, 21 nt, Artificial Sequence
  Synthetic
uaugucuuaaaagcuuauuug

SEQ ID NO: 4064 - RNA, 22 nt, Artificial Sequence
  Synthetic
guaugucuuaaaagcuuauuug

SEQ ID NO: 4065 - RNA, 23 nt, Artificial Sequence
  Synthetic
gguaugucuuaaaagcuuauuug

SEQ ID NO: 4066 - RNA, 24 nt, Artificial Sequence
  Synthetic
ggguaugucuuaaaagcuuauuug

SEQ ID NO: 4067 - RNA, 18 nt, Artificial Sequence
  Synthetic
aauaauuaauagagauau

SEQ ID NO: 4068 - RNA, 19 nt, Artificial Sequence
  Synthetic
uaauaauuaauagagauau

SEQ ID NO: 4069 - RNA, 20 nt, Artificial Sequence
  Synthetic
uuaauaauuaauagagauau

SEQ ID NO: 4070 - RNA, 21 nt, Artificial Sequence
  Synthetic
auuaauaauuaauagagauau

SEQ ID NO: 4071 - RNA, 22 nt, Artificial Sequence
  Synthetic
cauuaauaauuaauagagauau

SEQ ID NO: 4072 - RNA, 23 nt, Artificial Sequence
  Synthetic
ucauuaauaauuaauagagauau

SEQ ID NO: 4073 - RNA, 24 nt, Artificial Sequence
  Synthetic
uucauuaauaauuaauagagauau

SEQ ID NO: 4074 - RNA, 18 nt, Artificial Sequence
  Synthetic
ccagcaguucaaugauau

SEQ ID NO: 4075 - RNA, 19 nt, Artificial Sequence
  Synthetic
accagcaguucaaugauau

SEQ ID NO: 4076 - RNA, 20 nt, Artificial Sequence
  Synthetic
uaccagcaguucaaugauau

SEQ ID NO: 4077 - RNA, 21 nt, Artificial Sequence
  Synthetic
uuaccagcaguucaaugauau

SEQ ID NO: 4078 - RNA, 22 nt, Artificial Sequence
  Synthetic
auuaccagcaguucaaugauau

SEQ ID NO: 4079 - RNA, 23 nt, Artificial Sequence
  Synthetic
cauuaccagcaguucaaugauau

SEQ ID NO: 4080 - RNA, 24 nt, Artificial Sequence
  Synthetic
gcauuaccagcaguucaaugauau

SEQ ID NO: 4081 - RNA, 18 nt, Artificial Sequence
  Synthetic
gaggugcauugaaguuau

SEQ ID NO: 4082 - RNA, 19 nt, Artificial Sequence
  Synthetic
ggaggugcauugaaguuau

SEQ ID NO: 4083 - RNA, 20 nt, Artificial Sequence
  Synthetic
aggaggugcauugaaguuau

SEQ ID NO: 4084 - RNA, 21 nt, Artificial Sequence
  Synthetic
gaggaggugcauugaaguuau

SEQ ID NO: 4085 - RNA, 22 nt, Artificial Sequence
  Synthetic
ggaggaggugcauugaaguuau

SEQ ID NO: 4086 - RNA, 23 nt, Artificial Sequence
  Synthetic
gggaggaggugcauugaaguuau

SEQ ID NO: 4087 - RNA, 24 nt, Artificial Sequence
  Synthetic
agggaggaggugcauugaaguuau

SEQ ID NO: 4088 - RNA, 18 nt, Artificial Sequence
  Synthetic
cuuauucaacagaucacu

SEQ ID NO: 4089 - RNA, 19 nt, Artificial Sequence
  Synthetic
ccuuauucaacagaucacu

SEQ ID NO: 4090 - RNA, 20 nt, Artificial Sequence
  Synthetic
gccuuauucaacagaucacu

SEQ ID NO: 4091 - RNA, 21 nt, Artificial Sequence
  Synthetic
agccuuauucaacagaucacu

SEQ ID NO: 4092 - RNA, 22 nt, Artificial Sequence
  Synthetic
uagccuuauucaacagaucacu

SEQ ID NO: 4093 - RNA, 23 nt, Artificial Sequence
  Synthetic
cuagccuuauucaacagaucacu

SEQ ID NO: 4094 - RNA, 24 nt, Artificial Sequence
  Synthetic
ucuagccuuauucaacagaucacu

SEQ ID NO: 4095 - RNA, 18 nt, Artificial Sequence
  Synthetic
accagugauuccuugccu

SEQ ID NO: 4096 - RNA, 19 nt, Artificial Sequence
  Synthetic
aaccagugauuccuugccu

SEQ ID NO: 4097 - RNA, 20 nt, Artificial Sequence
  Synthetic
aaaccagugauuccuugccu

SEQ ID NO: 4098 - RNA, 21 nt, Artificial Sequence
  Synthetic
caaaccagugauuccuugccu

SEQ ID NO: 4099 - RNA, 22 nt, Artificial Sequence
  Synthetic
acaaaccagugauuccuugccu

SEQ ID NO: 4100 - RNA, 23 nt, Artificial Sequence
  Synthetic
uacaaaccagugauuccuugccu

SEQ ID NO: 4101 - RNA, 24 nt, Artificial Sequence
  Synthetic
guacaaaccagugauuccuugccu

SEQ ID NO: 4102 - RNA, 18 nt, Artificial Sequence
  Synthetic
aucuugauccaacauucu

SEQ ID NO: 4103 - RNA, 19 nt, Artificial Sequence
  Synthetic
uaucuugauccaacauucu

SEQ ID NO: 4104 - RNA, 20 nt, Artificial Sequence
  Synthetic
uuaucuugauccaacauucu

SEQ ID NO: 4105 - RNA, 21 nt, Artificial Sequence
  Synthetic
uuuaucuugauccaacauucu

SEQ ID NO: 4106 - RNA, 22 nt, Artificial Sequence
  Synthetic
auuuaucuugauccaacauucu

SEQ ID NO: 4107 - RNA, 23 nt, Artificial Sequence
  Synthetic
gauuuaucuugauccaacauucu

SEQ ID NO: 4108 - RNA, 24 nt, Artificial Sequence
  Synthetic
ugauuuaucuugauccaacauucu

SEQ ID NO: 4109 - RNA, 18 nt, Artificial Sequence
  Synthetic
uugaaaauacagaaauuu

SEQ ID NO: 4110 - RNA, 19 nt, Artificial Sequence
  Synthetic
cuugaaaauacagaaauuu

SEQ ID NO: 4111 - RNA, 20 nt, Artificial Sequence
  Synthetic
ucuugaaaauacagaaauuu

SEQ ID NO: 4112 - RNA, 21 nt, Artificial Sequence
  Synthetic
cucuugaaaauacagaaauuu

SEQ ID NO: 4113 - RNA, 22 nt, Artificial Sequence
  Synthetic
ucucuugaaaauacagaaauuu

SEQ ID NO: 4114 - RNA, 23 nt, Artificial Sequence
  Synthetic
gucucuugaaaauacagaaauuu

SEQ ID NO: 4115 - RNA, 24 nt, Artificial Sequence
  Synthetic
agucucuugaaaauacagaaauuu

SEQ ID NO: 4116 - RNA, 18 nt, Artificial Sequence
  Synthetic
gacuugucaucuugauuu

SEQ ID NO: 4117 - RNA, 19 nt, Artificial Sequence
  Synthetic
ugacuugucaucuugauuu

SEQ ID NO: 4118 - RNA, 20 nt, Artificial Sequence
  Synthetic
uugacuugucaucuugauuu

SEQ ID NO: 4119 - RNA, 21 nt, Artificial Sequence
  Synthetic
guugacuugucaucuugauuu

SEQ ID NO: 4120 - RNA, 22 nt, Artificial Sequence
  Synthetic
aguugacuugucaucuugauuu

SEQ ID NO: 4121 - RNA, 23 nt, Artificial Sequence
  Synthetic
caguugacuugucaucuugauuu

SEQ ID NO: 4122 - RNA, 24 nt, Artificial Sequence
  Synthetic
ucaguugacuugucaucuugauuu

SEQ ID NO: 4123 - RNA, 18 nt, Artificial Sequence
  Synthetic
ugucuuaaaagcuuauuu

SEQ ID NO: 4124 - RNA, 19 nt, Artificial Sequence
  Synthetic
augucuuaaaagcuuauuu

SEQ ID NO: 4125 - RNA, 20 nt, Artificial Sequence
  Synthetic
uaugucuuaaaagcuuauuu

SEQ ID NO: 4126 - RNA, 21 nt, Artificial Sequence
  Synthetic
guaugucuuaaaagcuuauuu

SEQ ID NO: 4127 - RNA, 22 nt, Artificial Sequence
  Synthetic
gguaugucuuaaaagcuuauuu

SEQ ID NO: 4128 - RNA, 23 nt, Artificial Sequence
  Synthetic
ggguaugucuuaaaagcuuauuu

SEQ ID NO: 4129 - RNA, 24 nt, Artificial Sequence
  Synthetic
aggguaugucuuaaaagcuuauuu

SEQ ID NO: 4130 - RNA, 18 nt, Artificial Sequence
  Synthetic
aaauuuuaguauuuuuuu

SEQ ID NO: 4131 - RNA, 19 nt, Artificial Sequence
  Synthetic
aaaauuuuaguauuuuuuu

SEQ ID NO: 4132 - RNA, 20 nt, Artificial Sequence
  Synthetic
aaaaauuuuaguauuuuuuu

SEQ ID NO: 4133 - RNA, 21 nt, Artificial Sequence
  Synthetic
uaaaaauuuuaguauuuuuuu

SEQ ID NO: 4134 - RNA, 22 nt, Artificial Sequence
  Synthetic
cuaaaaauuuuaguauuuuuuu

SEQ ID NO: 4135 - RNA, 23 nt, Artificial Sequence
  Synthetic
ucuaaaaauuuuaguauuuuuuu

SEQ ID NO: 4136 - RNA, 24 nt, Artificial Sequence
  Synthetic
cucuaaaaauuuuaguauuuuuuu

SEQ ID NO: 4137 - RNA, 17 nt, Artificial Sequence
  Synthetic
gaggaauuuugauuaag

SEQ ID NO: 4138 - RNA, 17 nt, Artificial Sequence
  Synthetic
gagauauaugaacacau

SEQ ID NO: 4139 - RNA, 17 nt, Artificial Sequence
  Synthetic
gauuuaggguaugucuu

SEQ ID NO: 4140 - RNA, 20 nt, Artificial Sequence
  Synthetic
ggcuagaguacuucccgcaa

SEQ ID NO: 4141 - RNA, 20 nt, Artificial Sequence
  Synthetic
gaaacauaguauugagaaua

SEQ ID NO: 4142 - RNA, 20 nt, Artificial Sequence
  Synthetic
guuuaacuuucaacauauua

SEQ ID NO: 4143 - RNA, 20 nt, Artificial Sequence
  Synthetic
ggcaauuuguaaaucuuugg

SEQ ID NO: 4144 - RNA, 20 nt, Artificial Sequence
  Synthetic
guauuuagguguuugugcug

SEQ ID NO: 4145 - RNA, 20 nt, Artificial Sequence
  Synthetic
gcacaaacaccuaaauacuu

SEQ ID NO: 4146 - RNA, 17 nt, Artificial Sequence
  Synthetic
uagaguacuucccgcaa

SEQ ID NO: 4147 - RNA, 17 nt, Artificial Sequence
  Synthetic
auauaccauaugaggaa

SEQ ID NO: 4148 - RNA, 17 nt, Artificial Sequence
  Synthetic
uuucaguugacuuguca

SEQ ID NO: 4149 - RNA, 17 nt, Artificial Sequence
  Synthetic
acauaguauugagaaua

SEQ ID NO: 4150 - RNA, 17 nt, Artificial Sequence
  Synthetic
uaacuuucaacauauua

SEQ ID NO: 4151 - RNA, 17 nt, Artificial Sequence
  Synthetic
cuuuguuggguacaaac

SEQ ID NO: 4152 - RNA, 17 nt, Artificial Sequence
  Synthetic
aaccuuuaaagcuaaac

SEQ ID NO: 4153 - RNA, 17 nt, Artificial Sequence
  Synthetic
cacaguacuggauaguc

SEQ ID NO: 4154 - RNA, 17 nt, Artificial Sequence
  Synthetic
aauuuguaaaucuuugg

SEQ ID NO: 4155 - RNA, 17 nt, Artificial Sequence
  Synthetic
uuuagguguuugugcug

SEQ ID NO: 4156 - RNA, 17 nt, Artificial Sequence
  Synthetic
uacuuuuggaugaacuu

SEQ ID NO: 4157 - RNA, 17 nt, Artificial Sequence
  Synthetic
cacauaauaauuaguuu

SEQ ID NO: 4158 - RNA, 20 nt, Artificial Sequence
  Synthetic
acaauauaccauaugaggaa

SEQ ID NO: 4159 - RNA, 20 nt, Artificial Sequence
  Synthetic
aaauuucaguugacuuguca

SEQ ID NO: 4160 - RNA, 20 nt, Artificial Sequence
  Synthetic
agacuuuguuggguacaaac

SEQ ID NO: 4161 - RNA, 20 nt, Artificial Sequence
  Synthetic
uaaaaccuuuaaagcuaaac

SEQ ID NO: 4162 - RNA, 20 nt, Artificial Sequence
  Synthetic
uaucacaguacuggauaguc

SEQ ID NO: 4163 - RNA, 20 nt, Artificial Sequence
  Synthetic
uaugaggaauuuugauuaag

SEQ ID NO: 4164 - RNA, 20 nt, Artificial Sequence
  Synthetic
auagagauauaugaacacau

SEQ ID NO: 4165 - RNA, 20 nt, Artificial Sequence
  Synthetic
auaugcugcuuauacccacu

SEQ ID NO: 4166 - RNA, 20 nt, Artificial Sequence
  Synthetic
cuauacuuuuggaugaacuu

SEQ ID NO: 4167 - RNA, 20 nt, Artificial Sequence
  Synthetic
uuagauuuaggguaugucuu

SEQ ID NO: 4168 - RNA, 20 nt, Artificial Sequence
  Synthetic
gaaauaauuuauaagaauau

SEQ ID NO: 4169 - RNA, 17 nt, Artificial Sequence
  Synthetic
uuauuagaaaacacuga

SEQ ID NO: 4170 - RNA, 17 nt, Artificial Sequence
  Synthetic
auaauuuauaagaauau

SEQ ID NO: 4171 - RNA, 17 nt, Artificial Sequence
  Synthetic
ugcugcuuauacccacu

SEQ ID NO: 4172 - RNA, 17 nt, Artificial Sequence
  Synthetic
caaacaccuaaauacuu

SEQ ID NO: 4173 - RNA, 17 nt, Artificial Sequence
  Synthetic
uuccgggauuuguuuuu

SEQ ID NO: 4174 - RNA, 20 nt, Artificial Sequence
  Synthetic
aaguuauuagaaaacacuga

SEQ ID NO: 4175 - RNA, 20 nt, Artificial Sequence
  Synthetic
aguuuccgggauuuguuuuu

SEQ ID NO: 4176 - RNA, 17 nt, Artificial Sequence
  Synthetic
gauaccuccccuuggaa

SEQ ID NO: 4177 - RNA, 17 nt, Artificial Sequence
  Synthetic
gggcgcagggugggaca

SEQ ID NO: 4178 - RNA, 17 nt, Artificial Sequence
  Synthetic
gccucacucggguucca

SEQ ID NO: 4179 - RNA, 17 nt, Artificial Sequence
  Synthetic
gggagaaugugggcgca

SEQ ID NO: 4180 - RNA, 17 nt, Artificial Sequence
  Synthetic
ggacuaaccgaccugua

SEQ ID NO: 4181 - RNA, 17 nt, Artificial Sequence
  Synthetic
gcacccucaaucccuac

SEQ ID NO: 4182 - RNA, 17 nt, Artificial Sequence
  Synthetic
gaugggagagggcacuc

SEQ ID NO: 4183 - RNA, 17 nt, Artificial Sequence
  Synthetic
gacaugggcauggccag

SEQ ID NO: 4184 - RNA, 17 nt, Artificial Sequence
  Synthetic
ggcgcagggugggacau

SEQ ID NO: 4185 - RNA, 17 nt, Artificial Sequence
  Synthetic
ggucaaggcugagcucu

SEQ ID NO: 4186 - RNA, 17 nt, Artificial Sequence
  Synthetic
gaaugugggcgcagggu

SEQ ID NO: 4187 - RNA, 17 nt, Artificial Sequence
  Synthetic
gggacuaaccgaccugu

SEQ ID NO: 4188 - RNA, 17 nt, Artificial Sequence
  Synthetic
gagccccggaguggauu

SEQ ID NO: 4189 - RNA, 20 nt, Artificial Sequence
  Synthetic
gugggacaugggcauggcca

SEQ ID NO: 4190 - RNA, 20 nt, Artificial Sequence
  Synthetic
gcagccucacucggguucca

SEQ ID NO: 4191 - RNA, 20 nt, Artificial Sequence
  Synthetic
gagcaguaucaagguaagca

SEQ ID NO: 4192 - RNA, 20 nt, Artificial Sequence
  Synthetic
gugaugggagagggcacuca

SEQ ID NO: 4193 - RNA, 20 nt, Artificial Sequence
  Synthetic
guaugggcugcagaggucua

SEQ ID NO: 4194 - RNA, 20 nt, Artificial Sequence
  Synthetic
gagggacuaaccgaccugua

SEQ ID NO: 4195 - RNA, 20 nt, Artificial Sequence
  Synthetic
gugcccucucccaucacccc

SEQ ID NO: 4196 - RNA, 20 nt, Artificial Sequence
  Synthetic
ggugggacaugggcauggcc

SEQ ID NO: 4197 - RNA, 20 nt, Artificial Sequence
  Synthetic
ggcagccucacucggguucc

SEQ ID NO: 4198 - RNA, 20 nt, Artificial Sequence
  Synthetic
gagugggagaaugugggcgc

SEQ ID NO: 4199 - RNA, 20 nt, Artificial Sequence
  Synthetic
ggugaugggagagggcacuc

SEQ ID NO: 4200 - RNA, 20 nt, Artificial Sequence
  Synthetic
ggccaggggcagccucacuc

SEQ ID NO: 4201 - RNA, 20 nt, Artificial Sequence
  Synthetic
gauuggggagagcaaggguc

SEQ ID NO: 4202 - RNA, 20 nt, Artificial Sequence
  Synthetic
gcucuccccaauccacuccg

SEQ ID NO: 4203 - RNA, 20 nt, Artificial Sequence
  Synthetic
gggagaaugugggcgcaggg

SEQ ID NO: 4204 - RNA, 20 nt, Artificial Sequence
  Synthetic
gugggcgcagggugggacau

SEQ ID NO: 4205 - RNA, 20 nt, Artificial Sequence
  Synthetic
gguaugggcugcagaggucu

SEQ ID NO: 4206 - RNA, 20 nt, Artificial Sequence
  Synthetic
ggagaaugugggcgcagggu

SEQ ID NO: 4207 - RNA, 17 nt, Artificial Sequence
  Synthetic
ccagcugucccuuccaa

SEQ ID NO: 4208 - RNA, 17 nt, Artificial Sequence
  Synthetic
aguaucaagguaagcaa

SEQ ID NO: 4209 - RNA, 17 nt, Artificial Sequence
  Synthetic
acuccggggcucaugaa

SEQ ID NO: 4210 - RNA, 17 nt, Artificial Sequence
  Synthetic
caguaucaagguaagca

SEQ ID NO: 4211 - RNA, 17 nt, Artificial Sequence
  Synthetic
uaucaugagcaguauca

SEQ ID NO: 4212 - RNA, 17 nt, Artificial Sequence
  Synthetic
augggagagggcacuca

SEQ ID NO: 4213 - RNA, 17 nt, Artificial Sequence
  Synthetic
ugauaccuccccuugga

SEQ ID NO: 4214 - RNA, 17 nt, Artificial Sequence
  Synthetic
cacuccggggcucauga

SEQ ID NO: 4215 - RNA, 17 nt, Artificial Sequence
  Synthetic
ucggguuccagggguga

SEQ ID NO: 4216 - RNA, 17 nt, Artificial Sequence
  Synthetic
cgaccuguagggauuga

SEQ ID NO: 4217 - RNA, 17 nt, Artificial Sequence
  Synthetic
ccucugcagcccauacc

SEQ ID NO: 4218 - RNA, 17 nt, Artificial Sequence
  Synthetic
ccgagugaggcugcccc

SEQ ID NO: 4219 - RNA, 17 nt, Artificial Sequence
  Synthetic
ucuccccaauccacucc

SEQ ID NO: 4220 - RNA, 17 nt, Artificial Sequence
  Synthetic
agccucacucggguucc

SEQ ID NO: 4221 - RNA, 17 nt, Artificial Sequence
  Synthetic
cccuuggaagggacagc

SEQ ID NO: 4222 - RNA, 17 nt, Artificial Sequence
  Synthetic
ugggagaaugugggcgc

SEQ ID NO: 4223 - RNA, 17 nt, Artificial Sequence
  Synthetic
cucuccccaauccacuc

SEQ ID NO: 4224 - RNA, 17 nt, Artificial Sequence
  Synthetic
caggggcagccucacuc

SEQ ID NO: 4225 - RNA, 17 nt, Artificial Sequence
  Synthetic
uggggagagcaaggguc

SEQ ID NO: 4226 - RNA, 17 nt, Artificial Sequence
  Synthetic
cagcugucccuuccaag

SEQ ID NO: 4227 - RNA, 17 nt, Artificial Sequence
  Synthetic
cuccggggcucaugaag

SEQ ID NO: 4228 - RNA, 17 nt, Artificial Sequence
  Synthetic
ccucacucggguuccag

SEQ ID NO: 4229 - RNA, 17 nt, Artificial Sequence
  Synthetic
ccugguaugggcugcag

SEQ ID NO: 4230 - RNA, 17 nt, Artificial Sequence
  Synthetic
cuucaugagccccggag

SEQ ID NO: 4231 - RNA, 17 nt, Artificial Sequence
  Synthetic
cuccccaauccacuccg

SEQ ID NO: 4232 - RNA, 17 nt, Artificial Sequence
  Synthetic
agaaugugggcgcaggg

SEQ ID NO: 4233 - RNA, 17 nt, Artificial Sequence
  Synthetic
cugucccuuccaagggg

SEQ ID NO: 4234 - RNA, 17 nt, Artificial Sequence
  Synthetic
ccccuggaacccgagug

SEQ ID NO: 4235 - RNA, 17 nt, Artificial Sequence
  Synthetic
ccgaccuguagggauug

SEQ ID NO: 4236 - RNA, 17 nt, Artificial Sequence
  Synthetic
agccccggaguggauug

SEQ ID NO: 4237 - RNA, 17 nt, Artificial Sequence
  Synthetic
ugagccccggaguggau

SEQ ID NO: 4238 - RNA, 17 nt, Artificial Sequence
  Synthetic
cggguuccaggggugau

SEQ ID NO: 4239 - RNA, 17 nt, Artificial Sequence
  Synthetic
augggcugcagaggucu

SEQ ID NO: 4240 - RNA, 17 nt, Artificial Sequence
  Synthetic
ccucaaucccuacaggu

SEQ ID NO: 4241 - RNA, 17 nt, Artificial Sequence
  Synthetic
agcaagggaaccugguu

SEQ ID NO: 4242 - RNA, 20 nt, Artificial Sequence
  Synthetic
agcaguaucaagguaagcaa

SEQ ID NO: 4243 - RNA, 20 nt, Artificial Sequence
  Synthetic
caugauaccuccccuuggaa

SEQ ID NO: 4244 - RNA, 20 nt, Artificial Sequence
  Synthetic
ugugggcgcagggugggaca

SEQ ID NO: 4245 - RNA, 20 nt, Artificial Sequence
  Synthetic
agugggagaaugugggcgca

SEQ ID NO: 4246 - RNA, 20 nt, Artificial Sequence
  Synthetic
agguaucaugagcaguauca

SEQ ID NO: 4247 - RNA, 20 nt, Artificial Sequence
  Synthetic
auuggggagagcaaggguca

SEQ ID NO: 4248 - RNA, 20 nt, Artificial Sequence
  Synthetic
ucaugauaccuccccuugga

SEQ ID NO: 4249 - RNA, 20 nt, Artificial Sequence
  Synthetic
auccacuccggggcucauga

SEQ ID NO: 4250 - RNA, 20 nt, Artificial Sequence
  Synthetic
cacucggguuccagggguga

SEQ ID NO: 4251 - RNA, 20 nt, Artificial Sequence
  Synthetic
aaccgaccuguagggauuga

SEQ ID NO: 4252 - RNA, 20 nt, Artificial Sequence
  Synthetic
ucugcacccucaaucccuac

SEQ ID NO: 4253 - RNA, 20 nt, Artificial Sequence
  Synthetic
ucaagguaagcaagggaacc

SEQ ID NO: 4254 - RNA, 20 nt, Artificial Sequence
  Synthetic
agaccucugcagcccauacc

SEQ ID NO: 4255 - RNA, 20 nt, Artificial Sequence
  Synthetic
aacccgagugaggcugcccc

SEQ ID NO: 4256 - RNA, 20 nt, Artificial Sequence
  Synthetic
uagucccucugccccuuccc

SEQ ID NO: 4257 - RNA, 20 nt, Artificial Sequence
  Synthetic
ugcucuccccaauccacucc

SEQ ID NO: 4258 - RNA, 20 nt, Artificial Sequence
  Synthetic
cuccccuuggaagggacagc

SEQ ID NO: 4259 - RNA, 20 nt, Artificial Sequence
  Synthetic
uugcucuccccaauccacuc

SEQ ID NO: 4260 - RNA, 20 nt, Artificial Sequence
  Synthetic
ucagggucaaggcugagcuc

SEQ ID NO: 4261 - RNA, 20 nt, Artificial Sequence
  Synthetic
auccagcugucccuuccaag

SEQ ID NO: 4262 - RNA, 20 nt, Artificial Sequence
  Synthetic
ugggacaugggcauggccag

SEQ ID NO: 4263 - RNA, 20 nt, Artificial Sequence
  Synthetic
cagccucacucggguuccag

SEQ ID NO: 4264 - RNA, 20 nt, Artificial Sequence
  Synthetic
agaccugguaugggcugcag

SEQ ID NO: 4265 - RNA, 20 nt, Artificial Sequence
  Synthetic
cagcugucccuuccaagggg

SEQ ID NO: 4266 - RNA, 20 nt, Artificial Sequence
  Synthetic
ucaccccuggaacccgagug

SEQ ID NO: 4267 - RNA, 20 nt, Artificial Sequence
  Synthetic
uaaccgaccuguagggauug

SEQ ID NO: 4268 - RNA, 20 nt, Artificial Sequence
  Synthetic
augagccccggaguggauug

SEQ ID NO: 4269 - RNA, 20 nt, Artificial Sequence
  Synthetic
ucaugagccccggaguggau

SEQ ID NO: 4270 - RNA, 20 nt, Artificial Sequence
  Synthetic
acucggguuccaggggugau

SEQ ID NO: 4271 - RNA, 20 nt, Artificial Sequence
  Synthetic
cagggucaaggcugagcucu

SEQ ID NO: 4272 - RNA, 20 nt, Artificial Sequence
  Synthetic
cacccucaaucccuacaggu

SEQ ID NO: 4273 - RNA, 20 nt, Artificial Sequence
  Synthetic
agagggacuaaccgaccugu

SEQ ID NO: 4274 - RNA, 20 nt, Artificial Sequence
  Synthetic
caugagccccggaguggauu

SEQ ID NO: 4275 - RNA, 17 nt, Artificial Sequence
  Synthetic
ggacaugggcauggcca

SEQ ID NO: 4276 - RNA, 17 nt, Artificial Sequence
  Synthetic
guggauuggggagagca

SEQ ID NO: 4277 - RNA, 17 nt, Artificial Sequence
  Synthetic
ggggagagcaaggguca

SEQ ID NO: 4278 - RNA, 17 nt, Artificial Sequence
  Synthetic
gggacaugggcauggcc

SEQ ID NO: 4279 - RNA, 17 nt, Artificial Sequence
  Synthetic
gggucaaggcugagcuc

SEQ ID NO: 4280 - RNA, 17 nt, Artificial Sequence
  Synthetic
gaaggggaacaagcugg

SEQ ID NO: 4281 - RNA, 20 nt, Artificial Sequence
  Synthetic
gaguggauuggggagagcaa

SEQ ID NO: 4282 - RNA, 20 nt, Artificial Sequence
  Synthetic
ggaguggauuggggagagca

SEQ ID NO: 4283 - RNA, 20 nt, Artificial Sequence
  Synthetic
gagagcaagggucaggguca

SEQ ID NO: 4284 - RNA, 20 nt, Artificial Sequence
  Synthetic
guuccaggggugaugggaga

SEQ ID NO: 4285 - RNA, 20 nt, Artificial Sequence
  Synthetic
gguuccaggggugaugggag

SEQ ID NO: 4286 - RNA, 20 nt, Artificial Sequence
  Synthetic
guaagcaagggaaccugguu

SEQ ID NO: 4287 - RNA, 17 nt, Artificial Sequence
  Synthetic
uggauuggggagagcaa

SEQ ID NO: 4288 - RNA, 17 nt, Artificial Sequence
  Synthetic
uccagcugucccuucca

SEQ ID NO: 4289 - RNA, 17 nt, Artificial Sequence
  Synthetic
agggugggacaugggca

SEQ ID NO: 4290 - RNA, 17 nt, Artificial Sequence
  Synthetic
agcaagggucaggguca

SEQ ID NO: 4291 - RNA, 17 nt, Artificial Sequence
  Synthetic
accagggaaggggcaga

SEQ ID NO: 4292 - RNA, 17 nt, Artificial Sequence
  Synthetic
ccaggggugaugggaga

SEQ ID NO: 4293 - RNA, 17 nt, Artificial Sequence
  Synthetic
ugggcugcagaggucua

SEQ ID NO: 4294 - RNA, 17 nt, Artificial Sequence
  Synthetic
agguaagcaagggaacc

SEQ ID NO: 4295 - RNA, 17 nt, Artificial Sequence
  Synthetic
cccucucccaucacccc

SEQ ID NO: 4296 - RNA, 17 nt, Artificial Sequence
  Synthetic
ucccucugccccuuccc

SEQ ID NO: 4297 - RNA, 17 nt, Artificial Sequence
  Synthetic
uccaggggugaugggag

SEQ ID NO: 4298 - RNA, 17 nt, Artificial Sequence
  Synthetic
ccaggggcagccucacu

SEQ ID NO: 4299 - RNA, 17 nt, Artificial Sequence
  Synthetic
cucaugauaccuccccu

SEQ ID NO: 4300 - RNA, 20 nt, Artificial Sequence
  Synthetic
uccacuccggggcucaugaa

SEQ ID NO: 4301 - RNA, 20 nt, Artificial Sequence
  Synthetic
cgcagggugggacaugggca

SEQ ID NO: 4302 - RNA, 20 nt, Artificial Sequence
  Synthetic
ccacuccggggcucaugaag

SEQ ID NO: 4303 - RNA, 20 nt, Artificial Sequence
  Synthetic
ccccuucaugagccccggag

SEQ ID NO: 4304 - RNA, 20 nt, Artificial Sequence
  Synthetic
caugaaggggaacaagcugg

SEQ ID NO: 4305 - RNA, 20 nt, Artificial Sequence
  Synthetic
uggccaggggcagccucacu

SEQ ID NO: 4306 - RNA, 20 nt, Artificial Sequence
  Synthetic
cugcucaugauaccuccccu

SEQ ID NO: 4307 - RNA, 17 nt, Artificial Sequence
  Synthetic
gccccacaccuaagaaa

SEQ ID NO: 4308 - RNA, 17 nt, Artificial Sequence
  Synthetic
augccuggaaucaacaa

SEQ ID NO: 4309 - RNA, 17 nt, Artificial Sequence
  Synthetic
acccucaggcgcugcaa

SEQ ID NO: 4310 - RNA, 17 nt, Artificial Sequence
  Synthetic
ccauuccuaggaaagaa

SEQ ID NO: 4311 - RNA, 17 nt, Artificial Sequence
  Synthetic
ggcgacugcaccaagaa

SEQ ID NO: 4312 - RNA, 17 nt, Artificial Sequence
  Synthetic
acgcuggggauggagaa

SEQ ID NO: 4313 - RNA, 17 nt, Artificial Sequence
  Synthetic
ccauucuuuccuaggaa

SEQ ID NO: 4314 - RNA, 17 nt, Artificial Sequence
  Synthetic
aaccuguacccggggaa

SEQ ID NO: 4315 - RNA, 17 nt, Artificial Sequence
  Synthetic
agguagaguguggggaa

SEQ ID NO: 4316 - RNA, 17 nt, Artificial Sequence
  Synthetic
ugaauacacaccuggaa

SEQ ID NO: 4317 - RNA, 17 nt, Artificial Sequence
  Synthetic
auuuccggguaccugaa

SEQ ID NO: 4318 - RNA, 17 nt, Artificial Sequence
  Synthetic
gcuguguguacuuugaa

SEQ ID NO: 4319 - RNA, 17 nt, Artificial Sequence
  Synthetic
gccaccaucauccauaa

SEQ ID NO: 4320 - RNA, 17 nt, Artificial Sequence
  Synthetic
uguacuuugaaggguaa

SEQ ID NO: 4321 - RNA, 17 nt, Artificial Sequence
  Synthetic
gacuggggcccggguaa

SEQ ID NO: 4322 - RNA, 17 nt, Artificial Sequence
  Synthetic
aucucucuguacccaca

SEQ ID NO: 4323 - RNA, 17 nt, Artificial Sequence
  Synthetic
ggacaaggacagagaca

SEQ ID NO: 4324 - RNA, 17 nt, Artificial Sequence
  Synthetic
agggccuggcugggaca

SEQ ID NO: 4325 - RNA, 17 nt, Artificial Sequence
  Synthetic
agagguuucucacacca

SEQ ID NO: 4326 - RNA, 17 nt, Artificial Sequence
  Synthetic
ucuuguggcugggacca

SEQ ID NO: 4327 - RNA, 17 nt, Artificial Sequence
  Synthetic
agaugggcgggggccca

SEQ ID NO: 4328 - RNA, 17 nt, Artificial Sequence
  Synthetic
aggaggggaggaugcca

SEQ ID NO: 4329 - RNA, 17 nt, Artificial Sequence
  Synthetic
ccuggggugagacucca

SEQ ID NO: 4330 - RNA, 17 nt, Artificial Sequence
  Synthetic
cagcguguccuccucca

SEQ ID NO: 4331 - RNA, 17 nt, Artificial Sequence
  Synthetic
gcucccugcuugcucca

SEQ ID NO: 4332 - RNA, 17 nt, Artificial Sequence
  Synthetic
gcccccgcccaucucca

SEQ ID NO: 4333 - RNA, 17 nt, Artificial Sequence
  Synthetic
gcccccaagucugucca

SEQ ID NO: 4334 - RNA, 17 nt, Artificial Sequence
  Synthetic
gcgccauggagcaagca

SEQ ID NO: 4335 - RNA, 17 nt, Artificial Sequence
  Synthetic
agucacuguggacagca

SEQ ID NO: 4336 - RNA, 17 nt, Artificial Sequence
  Synthetic
aggcuggagagggagca

SEQ ID NO: 4337 - RNA, 17 nt, Artificial Sequence
  Synthetic
ucagcaugaggaaggca

SEQ ID NO: 4338 - RNA, 17 nt, Artificial Sequence
  Synthetic
guuguugauuccaggca

SEQ ID NO: 4339 - RNA, 17 nt, Artificial Sequence
  Synthetic
ccaggguggcauaggca

SEQ ID NO: 4340 - RNA, 17 nt, Artificial Sequence
  Synthetic
uccaggccgagggggca

SEQ ID NO: 4341 - RNA, 17 nt, Artificial Sequence
  Synthetic
ggggacacuaaccugca

SEQ ID NO: 4342 - RNA, 17 nt, Artificial Sequence
  Synthetic
gacccucaggcgcugca

SEQ ID NO: 4343 - RNA, 17 nt, Artificial Sequence
  Synthetic
cuccagggggcucugca

SEQ ID NO: 4344 - RNA, 17 nt, Artificial Sequence
  Synthetic
gcccggguaauggugca

SEQ ID NO: 4345 - RNA, 17 nt, Artificial Sequence
  Synthetic
cucugcgcgcagcauca

SEQ ID NO: 4346 - RNA, 17 nt, Artificial Sequence
  Synthetic
accagacauacucauca

SEQ ID NO: 4347 - RNA, 17 nt, Artificial Sequence
  Synthetic
gaaugggggugucauca

SEQ ID NO: 4348 - RNA, 17 nt, Artificial Sequence
  Synthetic
ccaggagagcaugauca

SEQ ID NO: 4349 - RNA, 17 nt, Artificial Sequence
  Synthetic
gucccgcccccgccuca

SEQ ID NO: 4350 - RNA, 17 nt, Artificial Sequence
  Synthetic
ccucuccuucccucuca

SEQ ID NO: 4351 - RNA, 17 nt, Artificial Sequence
  Synthetic
agggggaggggcuguca

SEQ ID NO: 4352 - RNA, 17 nt, Artificial Sequence
  Synthetic
ugagucucccucuguca

SEQ ID NO: 4353 - RNA, 17 nt, Artificial Sequence
  Synthetic
agucaacaucuucuuca

SEQ ID NO: 4354 - RNA, 17 nt, Artificial Sequence
  Synthetic
aaggggcgaggggaaga

SEQ ID NO: 4355 - RNA, 17 nt, Artificial Sequence
  Synthetic
accucuccucucacaga

SEQ ID NO: 4356 - RNA, 17 nt, Artificial Sequence
  Synthetic
cgaccuaccgugacaga

SEQ ID NO: 4357 - RNA, 17 nt, Artificial Sequence
  Synthetic
cuuagguguggggcaga

SEQ ID NO: 4358 - RNA, 17 nt, Artificial Sequence
  Synthetic
cagagacuagagucaga

SEQ ID NO: 4359 - RNA, 17 nt, Artificial Sequence
  Synthetic
ggaggguggagaggaga

SEQ ID NO: 4360 - RNA, 17 nt, Artificial Sequence
  Synthetic
gcagagcccccuggaga

SEQ ID NO: 4361 - RNA, 17 nt, Artificial Sequence
  Synthetic
gcugucaaggcuggaga

SEQ ID NO: 4362 - RNA, 17 nt, Artificial Sequence
  Synthetic
guugucugugguggaga

SEQ ID NO: 4363 - RNA, 17 nt, Artificial Sequence
  Synthetic
cugggggggcccugaga

SEQ ID NO: 4364 - RNA, 17 nt, Artificial Sequence
  Synthetic
cugcugguuacucacga

SEQ ID NO: 4365 - RNA, 17 nt, Artificial Sequence
  Synthetic
gagagguacauugacga

SEQ ID NO: 4366 - RNA, 17 nt, Artificial Sequence
  Synthetic
accugggaugucaccga

SEQ ID NO: 4367 - RNA, 17 nt, Artificial Sequence
  Synthetic
gaggcccgcagcgccga

SEQ ID NO: 4368 - RNA, 17 nt, Artificial Sequence
  Synthetic
acuggucuccaggccga

SEQ ID NO: 4369 - RNA, 17 nt, Artificial Sequence
  Synthetic
uccucaugcugcuccga

SEQ ID NO: 4370 - RNA, 17 nt, Artificial Sequence
  Synthetic
ucccccgcaggucgcga

SEQ ID NO: 4371 - RNA, 17 nt, Artificial Sequence
  Synthetic
gguaccugaaggggcga

SEQ ID NO: 4372 - RNA, 17 nt, Artificial Sequence
  Synthetic
ccacgcuacgggcucga

SEQ ID NO: 4373 - RNA, 17 nt, Artificial Sequence
  Synthetic
ggcagaagugggaagga

SEQ ID NO: 4374 - RNA, 17 nt, Artificial Sequence
  Synthetic
gcccagguuggacagga

SEQ ID NO: 4375 - RNA, 17 nt, Artificial Sequence
  Synthetic
acaccuggaagggagga

SEQ ID NO: 4376 - RNA, 17 nt, Artificial Sequence
  Synthetic
cuccaucagcaugagga

SEQ ID NO: 4377 - RNA, 17 nt, Artificial Sequence
  Synthetic
agaguguggggaaggga

SEQ ID NO: 4378 - RNA, 17 nt, Artificial Sequence
  Synthetic
guguccuccuccaggga

SEQ ID NO: 4379 - RNA, 17 nt, Artificial Sequence
  Synthetic
gggggcccugagaggga

SEQ ID NO: 4380 - RNA, 17 nt, Artificial Sequence
  Synthetic
caaccuguacccgggga

SEQ ID NO: 4381 - RNA, 17 nt, Artificial Sequence
  Synthetic
uggcauaggcaggggga

SEQ ID NO: 4382 - RNA, 17 nt, Artificial Sequence
  Synthetic
gcuggucacgcugggga

SEQ ID NO: 4383 - RNA, 17 nt, Artificial Sequence
  Synthetic
cagguagagugugggga

SEQ ID NO: 4384 - RNA, 17 nt, Artificial Sequence
  Synthetic
ugggggcagaaguggga

SEQ ID NO: 4385 - RNA, 17 nt, Artificial Sequence
  Synthetic
cccccagguggacugga

SEQ ID NO: 4386 - RNA, 17 nt, Artificial Sequence
  Synthetic
gugaauacacaccugga

SEQ ID NO: 4387 - RNA, 17 nt, Artificial Sequence
  Synthetic
ugacugggaggccugga

SEQ ID NO: 4388 - RNA, 17 nt, Artificial Sequence
  Synthetic
gguaggucgugccugga

SEQ ID NO: 4389 - RNA, 17 nt, Artificial Sequence
  Synthetic
ccugccuuuauggauga

SEQ ID NO: 4390 - RNA, 17 nt, Artificial Sequence
  Synthetic
aauuuccggguaccuga

SEQ ID NO: 4391 - RNA, 17 nt, Artificial Sequence
  Synthetic
ccccuugcagcgccuga

SEQ ID NO: 4392 - RNA, 17 nt, Artificial Sequence
  Synthetic
ugccuuccucaugcuga

SEQ ID NO: 4393 - RNA, 17 nt, Artificial Sequence
  Synthetic
agggguggaugcgguga

SEQ ID NO: 4394 - RNA, 17 nt, Artificial Sequence
  Synthetic
ggccacgagagugguga

SEQ ID NO: 4395 - RNA, 17 nt, Artificial Sequence
  Synthetic
ugaccucuuguuguuga

SEQ ID NO: 4396 - RNA, 17 nt, Artificial Sequence
  Synthetic
ugcuguguguacuuuga

SEQ ID NO: 4397 - RNA, 17 nt, Artificial Sequence
  Synthetic
cucucucuuuccugaua

SEQ ID NO: 4398 - RNA, 17 nt, Artificial Sequence
  Synthetic
caucagggacagaccua

SEQ ID NO: 4399 - RNA, 17 nt, Artificial Sequence
  Synthetic
agcuggaggccacgcua

SEQ ID NO: 4400 - RNA, 17 nt, Artificial Sequence
  Synthetic
ucaggaaagagagagua

SEQ ID NO: 4401 - RNA, 17 nt, Artificial Sequence
  Synthetic
uuccaccacccgaugua

SEQ ID NO: 4402 - RNA, 17 nt, Artificial Sequence
  Synthetic
agacuugggggcgauua

SEQ ID NO: 4403 - RNA, 17 nt, Artificial Sequence
  Synthetic
ggaugaaccugccuuua

SEQ ID NO: 4404 - RNA, 17 nt, Artificial Sequence
  Synthetic
ggguaaagguucucaac

SEQ ID NO: 4405 - RNA, 17 nt, Artificial Sequence
  Synthetic
aggacagguggaggaac

SEQ ID NO: 4406 - RNA, 17 nt, Artificial Sequence
  Synthetic
ccgaggagccgaaccac

SEQ ID NO: 4407 - RNA, 17 nt, Artificial Sequence
  Synthetic
caucucucuguacccac

SEQ ID NO: 4408 - RNA, 17 nt, Artificial Sequence
  Synthetic
cgaaccacaggcuccac

SEQ ID NO: 4409 - RNA, 17 nt, Artificial Sequence
  Synthetic
cccggguaauggugcac

SEQ ID NO: 4410 - RNA, 17 nt, Artificial Sequence
  Synthetic
auuuguucugguugcac

SEQ ID NO: 4411 - RNA, 17 nt, Artificial Sequence
  Synthetic
ucccgcccccgccucac

SEQ ID NO: 4412 - RNA, 17 nt, Artificial Sequence
  Synthetic
ucucuggcagccucgac

SEQ ID NO: 4413 - RNA, 17 nt, Artificial Sequence
  Synthetic
cacgcuacgggcucgac

SEQ ID NO: 4414 - RNA, 17 nt, Artificial Sequence
  Synthetic
agguggacuggaaggac

SEQ ID NO: 4415 - RNA, 17 nt, Artificial Sequence
  Synthetic
gggcccccccagaggac

SEQ ID NO: 4416 - RNA, 17 nt, Artificial Sequence
  Synthetic
acaacccccagguggac

SEQ ID NO: 4417 - RNA, 17 nt, Artificial Sequence
  Synthetic
ggcugcccagguuggac

SEQ ID NO: 4418 - RNA, 17 nt, Artificial Sequence
  Synthetic
aaggcaaggaugcugac

SEQ ID NO: 4419 - RNA, 17 nt, Artificial Sequence
  Synthetic
cugcuguccacagugac

SEQ ID NO: 4420 - RNA, 17 nt, Artificial Sequence
  Synthetic
gguuccgaagccgauac

SEQ ID NO: 4421 - RNA, 17 nt, Artificial Sequence
  Synthetic
gcuggaggccacgcuac

SEQ ID NO: 4422 - RNA, 17 nt, Artificial Sequence
  Synthetic
uccccuuccccggguac

SEQ ID NO: 4423 - RNA, 17 nt, Artificial Sequence
  Synthetic
aggagcuguauuuguac

SEQ ID NO: 4424 - RNA, 17 nt, Artificial Sequence
  Synthetic
cacccuccuguccaacc

SEQ ID NO: 4425 - RNA, 17 nt, Artificial Sequence
  Synthetic
ccaggucuccugcaacc

SEQ ID NO: 4426 - RNA, 17 nt, Artificial Sequence
  Synthetic
cugaggagaagucaacc

SEQ ID NO: 4427 - RNA, 17 nt, Artificial Sequence
  Synthetic
cgccugccgcuucaacc

SEQ ID NO: 4428 - RNA, 17 nt, Artificial Sequence
  Synthetic
aggagugaauacacacc

SEQ ID NO: 4429 - RNA, 17 nt, Artificial Sequence
  Synthetic
cuucuccucagaccacc

SEQ ID NO: 4430 - RNA, 17 nt, Artificial Sequence
  Synthetic
aguccuuccaguccacc

SEQ ID NO: 4431 - RNA, 17 nt, Artificial Sequence
  Synthetic
ccugguugcaggagacc

SEQ ID NO: 4432 - RNA, 17 nt, Artificial Sequence
  Synthetic
cuuccccacacucuacc

SEQ ID NO: 4433 - RNA, 17 nt, Artificial Sequence
  Synthetic
ucgccccuucagguacc

SEQ ID NO: 4434 - RNA, 17 nt, Artificial Sequence
  Synthetic
gcccgugcaccauuacc

SEQ ID NO: 4435 - RNA, 17 nt, Artificial Sequence
  Synthetic
ggguucauaggaaaccc

SEQ ID NO: 4436 - RNA, 17 nt, Artificial Sequence
  Synthetic
cccugccuaugccaccc

SEQ ID NO: 4437 - RNA, 17 nt, Artificial Sequence
  Synthetic
ggagguagccuccaccc

SEQ ID NO: 4438 - RNA, 17 nt, Artificial Sequence
  Synthetic
cccgugcaccauuaccc

SEQ ID NO: 4439 - RNA, 17 nt, Artificial Sequence
  Synthetic
cccuggagucucacccc

SEQ ID NO: 4440 - RNA, 17 nt, Artificial Sequence
  Synthetic
gcgggacaacaaccccc

SEQ ID NO: 4441 - RNA, 17 nt, Artificial Sequence
  Synthetic
gccccugcagagccccc

SEQ ID NO: 4442 - RNA, 17 nt, Artificial Sequence
  Synthetic
uuaguguccccuucccc

SEQ ID NO: 4443 - RNA, 17 nt, Artificial Sequence
  Synthetic
acuuggugaaacagccc

SEQ ID NO: 4444 - RNA, 17 nt, Artificial Sequence
  Synthetic
gagaugggcgggggccc

SEQ ID NO: 4445 - RNA, 17 nt, Artificial Sequence
  Synthetic
cacagugacuggggccc

SEQ ID NO: 4446 - RNA, 17 nt, Artificial Sequence
  Synthetic
agaggucaguccugccc

SEQ ID NO: 4447 - RNA, 17 nt, Artificial Sequence
  Synthetic
ggcuccacuggcugccc

SEQ ID NO: 4448 - RNA, 17 nt, Artificial Sequence
  Synthetic
gcccucggugacauccc

SEQ ID NO: 4449 - RNA, 17 nt, Artificial Sequence
  Synthetic
agagacucugccauccc

SEQ ID NO: 4450 - RNA, 17 nt, Artificial Sequence
  Synthetic
gcagggugggggcuccc

SEQ ID NO: 4451 - RNA, 17 nt, Artificial Sequence
  Synthetic
guuaguguccccuuccc

SEQ ID NO: 4452 - RNA, 17 nt, Artificial Sequence
  Synthetic
cuguccuugucccagcc

SEQ ID NO: 4453 - RNA, 17 nt, Artificial Sequence
  Synthetic
auggaggucuccacgcc

SEQ ID NO: 4454 - RNA, 17 nt, Artificial Sequence
  Synthetic
caggacugacucacgcc

SEQ ID NO: 4455 - RNA, 17 nt, Artificial Sequence
  Synthetic
augcugacugggaggcc

SEQ ID NO: 4456 - RNA, 17 nt, Artificial Sequence
  Synthetic
ggcuuuaacuugcggcc

SEQ ID NO: 4457 - RNA, 17 nt, Artificial Sequence
  Synthetic
ccccugcccccucggcc

SEQ ID NO: 4458 - RNA, 17 nt, Artificial Sequence
  Synthetic
ggagagggagcagggcc

SEQ ID NO: 4459 - RNA, 17 nt, Artificial Sequence
  Synthetic
ccacagugacuggggcc

SEQ ID NO: 4460 - RNA, 17 nt, Artificial Sequence
  Synthetic
uggaugucuuccaugcc

SEQ ID NO: 4461 - RNA, 17 nt, Artificial Sequence
  Synthetic
aaggaggggaggaugcc

SEQ ID NO: 4462 - RNA, 17 nt, Artificial Sequence
  Synthetic
cgugagucaguccugcc

SEQ ID NO: 4463 - RNA, 17 nt, Artificial Sequence
  Synthetic
ucacgguaggucgugcc

SEQ ID NO: 4464 - RNA, 17 nt, Artificial Sequence
  Synthetic
caucacaggcuccaucc

SEQ ID NO: 4465 - RNA, 17 nt, Artificial Sequence
  Synthetic
uccuggggugagacucc

SEQ ID NO: 4466 - RNA, 17 nt, Artificial Sequence
  Synthetic
ccagcguguccuccucc

SEQ ID NO: 4467 - RNA, 17 nt, Artificial Sequence
  Synthetic
cugcuacuauaagcucc

SEQ ID NO: 4468 - RNA, 17 nt, Artificial Sequence
  Synthetic
ggcccccgcccaucucc

SEQ ID NO: 4469 - RNA, 17 nt, Artificial Sequence
  Synthetic
ccuugaucaugcucucc

SEQ ID NO: 4470 - RNA, 17 nt, Artificial Sequence
  Synthetic
agccgauacuggucucc

SEQ ID NO: 4471 - RNA, 17 nt, Artificial Sequence
  Synthetic
cgcccccaagucugucc

SEQ ID NO: 4472 - RNA, 17 nt, Artificial Sequence
  Synthetic
ucaccguuguugauucc

SEQ ID NO: 4473 - RNA, 17 nt, Artificial Sequence
  Synthetic
ccacccuccucccuucc

SEQ ID NO: 4474 - RNA, 17 nt, Artificial Sequence
  Synthetic
uauucacuccugcuucc

SEQ ID NO: 4475 - RNA, 17 nt, Artificial Sequence
  Synthetic
acagaaagcacaguucc

SEQ ID NO: 4476 - RNA, 17 nt, Artificial Sequence
  Synthetic
gcuccucuuuaauuucc

SEQ ID NO: 4477 - RNA, 17 nt, Artificial Sequence
  Synthetic
ggcgccauggagcaagc

SEQ ID NO: 4478 - RNA, 17 nt, Artificial Sequence
  Synthetic
guuguugucccgcaagc

SEQ ID NO: 4479 - RNA, 17 nt, Artificial Sequence
  Synthetic
caugcucuccuggaagc

SEQ ID NO: 4480 - RNA, 17 nt, Artificial Sequence
  Synthetic
uucaaaguacacacagc

SEQ ID NO: 4481 - RNA, 17 nt, Artificial Sequence
  Synthetic
cagucacuguggacagc

SEQ ID NO: 4482 - RNA, 17 nt, Artificial Sequence
  Synthetic
cugcgggccucaccagc

SEQ ID NO: 4483 - RNA, 17 nt, Artificial Sequence
  Synthetic
ggaacaugaugaccagc

SEQ ID NO: 4484 - RNA, 17 nt, Artificial Sequence
  Synthetic
gaagaucggcuuccagc

SEQ ID NO: 4485 - RNA, 17 nt, Artificial Sequence
  Synthetic
aguaaccagcagagagc

SEQ ID NO: 4486 - RNA, 17 nt, Artificial Sequence
  Synthetic
ggaaauuaaagaggagc

SEQ ID NO: 4487 - RNA, 17 nt, Artificial Sequence
  Synthetic
agaggagcuggaggagc

SEQ ID NO: 4488 - RNA, 17 nt, Artificial Sequence
  Synthetic
aaggcuggagagggagc

SEQ ID NO: 4489 - RNA, 17 nt, Artificial Sequence
  Synthetic
gcgacggcugcgggagc

SEQ ID NO: 4490 - RNA, 17 nt, Artificial Sequence
  Synthetic
agcagagagcugguagc

SEQ ID NO: 4491 - RNA, 17 nt, Artificial Sequence
  Synthetic
ccuggaggaggacacgc

SEQ ID NO: 4492 - RNA, 17 nt, Artificial Sequence
  Synthetic
cugguagcuggucacgc

SEQ ID NO: 4493 - RNA, 17 nt, Artificial Sequence
  Synthetic
gcggcagagucccccgc

SEQ ID NO: 4494 - RNA, 17 nt, Artificial Sequence
  Synthetic
ccaucauccauaaaggc

SEQ ID NO: 4495 - RNA, 17 nt, Artificial Sequence
  Synthetic
ggaggggcugucaaggc

SEQ ID NO: 4496 - RNA, 17 nt, Artificial Sequence
  Synthetic
agagcaaggagccaggc

SEQ ID NO: 4497 - RNA, 17 nt, Artificial Sequence
  Synthetic
gacgggccccgugaggc

SEQ ID NO: 4498 - RNA, 17 nt, Artificial Sequence
  Synthetic
cccaggguggcauaggc

SEQ ID NO: 4499 - RNA, 17 nt, Artificial Sequence
  Synthetic
gaccugguugaagcggc

SEQ ID NO: 4500 - RNA, 17 nt, Artificial Sequence
  Synthetic
guggcugggaccagggc

SEQ ID NO: 4501 - RNA, 17 nt, Artificial Sequence
  Synthetic
gguaauggugcacgggc

SEQ ID NO: 4502 - RNA, 17 nt, Artificial Sequence
  Synthetic
cuccaggccgagggggc

SEQ ID NO: 4503 - RNA, 17 nt, Artificial Sequence
  Synthetic
ccccgugaggcgggggc

SEQ ID NO: 4504 - RNA, 17 nt, Artificial Sequence
  Synthetic
gcccccuggagaugggc

SEQ ID NO: 4505 - RNA, 17 nt, Artificial Sequence
  Synthetic
agggagcagggccuggc

SEQ ID NO: 4506 - RNA, 17 nt, Artificial Sequence
  Synthetic
uucaccacucucguggc

SEQ ID NO: 4507 - RNA, 17 nt, Artificial Sequence
  Synthetic
agugccggaagccaugc

SEQ ID NO: 4508 - RNA, 17 nt, Artificial Sequence
  Synthetic
cagccgucgcgaccugc

SEQ ID NO: 4509 - RNA, 17 nt, Artificial Sequence
  Synthetic
gcucgucuuugaccugc

SEQ ID NO: 4510 - RNA, 17 nt, Artificial Sequence
  Synthetic
gggccccucggcgcugc

SEQ ID NO: 4511 - RNA, 17 nt, Artificial Sequence
  Synthetic
caggucgcgacggcugc

SEQ ID NO: 4512 - RNA, 17 nt, Artificial Sequence
  Synthetic
ucuccagggggcucugc

SEQ ID NO: 4513 - RNA, 17 nt, Artificial Sequence
  Synthetic
agcuaccagcucucugc

SEQ ID NO: 4514 - RNA, 17 nt, Artificial Sequence
  Synthetic
gcuguuucaccaagugc

SEQ ID NO: 4515 - RNA, 17 nt, Artificial Sequence
  Synthetic
cguggccuccagcuugc

SEQ ID NO: 4516 - RNA, 17 nt, Artificial Sequence
  Synthetic
gacucacgccugguugc

SEQ ID NO: 4517 - RNA, 17 nt, Artificial Sequence
  Synthetic
agcaguuuccauacauc

SEQ ID NO: 4518 - RNA, 17 nt, Artificial Sequence
  Synthetic
gcucugcgcgcagcauc

SEQ ID NO: 4519 - RNA, 17 nt, Artificial Sequence
  Synthetic
ucugucgcgauagcauc

SEQ ID NO: 4520 - RNA, 17 nt, Artificial Sequence
  Synthetic
uaccagacauacucauc

SEQ ID NO: 4521 - RNA, 17 nt, Artificial Sequence
  Synthetic
gagaguaauuccuuauc

SEQ ID NO: 4522 - RNA, 17 nt, Artificial Sequence
  Synthetic
agaacaacuccaaccuc

SEQ ID NO: 4523 - RNA, 17 nt, Artificial Sequence
  Synthetic
gcgggggcgggacccuc

SEQ ID NO: 4524 - RNA, 17 nt, Artificial Sequence
  Synthetic
uuccuccaccuguccuc

SEQ ID NO: 4525 - RNA, 17 nt, Artificial Sequence
  Synthetic
agggggcaggggugcuc

SEQ ID NO: 4526 - RNA, 17 nt, Artificial Sequence
  Synthetic
accucuccuucccucuc

SEQ ID NO: 4527 - RNA, 17 nt, Artificial Sequence
  Synthetic
agggauggcagagucuc

SEQ ID NO: 4528 - RNA, 17 nt, Artificial Sequence
  Synthetic
gcgaggggaagaggguc

SEQ ID NO: 4529 - RNA, 17 nt, Artificial Sequence
  Synthetic
ccccugaugaguauguc

SEQ ID NO: 4530 - RNA, 17 nt, Artificial Sequence
  Synthetic
cuuccccucgccccuuc

SEQ ID NO: 4531 - RNA, 17 nt, Artificial Sequence
  Synthetic
cuaaccugcauggcuuc

SEQ ID NO: 4532 - RNA, 17 nt, Artificial Sequence
  Synthetic
cacaguacuccacguuc

SEQ ID NO: 4533 - RNA, 17 nt, Artificial Sequence
  Synthetic
agcaguccgauuuguuc

SEQ ID NO: 4534 - RNA, 17 nt, Artificial Sequence
  Synthetic
agcuccucuuuaauuuc

SEQ ID NO: 4535 - RNA, 17 nt, Artificial Sequence
  Synthetic
guacccggaaauuaaag

SEQ ID NO: 4536 - RNA, 17 nt, Artificial Sequence
  Synthetic
acaccgucaacaacaag

SEQ ID NO: 4537 - RNA, 17 nt, Artificial Sequence
  Synthetic
cccucaggcgcugcaag

SEQ ID NO: 4538 - RNA, 17 nt, Artificial Sequence
  Synthetic
uggggugggggcagaag

SEQ ID NO: 4539 - RNA, 17 nt, Artificial Sequence
  Synthetic
gaaggggcgaggggaag

SEQ ID NO: 4540 - RNA, 17 nt, Artificial Sequence
  Synthetic
accuguacccggggaag

SEQ ID NO: 4541 - RNA, 17 nt, Artificial Sequence
  Synthetic
uguugauguaguggaag

SEQ ID NO: 4542 - RNA, 17 nt, Artificial Sequence
  Synthetic
uuuccggguaccugaag

SEQ ID NO: 4543 - RNA, 17 nt, Artificial Sequence
  Synthetic
aggagaccugguugaag

SEQ ID NO: 4544 - RNA, 17 nt, Artificial Sequence
  Synthetic
acgaccuaccgugacag

SEQ ID NO: 4545 - RNA, 17 nt, Artificial Sequence
  Synthetic
ucucagggcccccccag

SEQ ID NO: 4546 - RNA, 17 nt, Artificial Sequence
  Synthetic
ccaaccugggcagccag

SEQ ID NO: 4547 - RNA, 17 nt, Artificial Sequence
  Synthetic
gcauggaagacauccag

SEQ ID NO: 4548 - RNA, 17 nt, Artificial Sequence
  Synthetic
cccccgcccaucuccag

SEQ ID NO: 4549 - RNA, 17 nt, Artificial Sequence
  Synthetic
gucacuguggacagcag

SEQ ID NO: 4550 - RNA, 17 nt, Artificial Sequence
  Synthetic
caggguggcauaggcag

SEQ ID NO: 4551 - RNA, 17 nt, Artificial Sequence
  Synthetic
ccaggccgagggggcag

SEQ ID NO: 4552 - RNA, 17 nt, Artificial Sequence
  Synthetic
ucuuagguguggggcag

SEQ ID NO: 4553 - RNA, 17 nt, Artificial Sequence
  Synthetic
uccagggggcucugcag

SEQ ID NO: 4554 - RNA, 17 nt, Artificial Sequence
  Synthetic
ccagacauacucaucag

SEQ ID NO: 4555 - RNA, 17 nt, Artificial Sequence
  Synthetic
acagagacuagagucag

SEQ ID NO: 4556 - RNA, 17 nt, Artificial Sequence
  Synthetic
agagacuagagucagag

SEQ ID NO: 4557 - RNA, 17 nt, Artificial Sequence
  Synthetic
ggagccggccacgagag

SEQ ID NO: 4558 - RNA, 17 nt, Artificial Sequence
  Synthetic
aggcccgcagcgccgag

SEQ ID NO: 4559 - RNA, 17 nt, Artificial Sequence
  Synthetic
cuggucuccaggccgag

SEQ ID NO: 4560 - RNA, 17 nt, Artificial Sequence
  Synthetic
guaccugaaggggcgag

SEQ ID NO: 4561 - RNA, 17 nt, Artificial Sequence
  Synthetic
cccugagagggaaggag

SEQ ID NO: 4562 - RNA, 17 nt, Artificial Sequence
  Synthetic
gcagaagugggaaggag

SEQ ID NO: 4563 - RNA, 17 nt, Artificial Sequence
  Synthetic
aggaggguggagaggag

SEQ ID NO: 4564 - RNA, 17 nt, Artificial Sequence
  Synthetic
accaucugugagaggag

SEQ ID NO: 4565 - RNA, 17 nt, Artificial Sequence
  Synthetic
uggaugcggugagggag

SEQ ID NO: 4566 - RNA, 17 nt, Artificial Sequence
  Synthetic
ggcauaggcagggggag

SEQ ID NO: 4567 - RNA, 17 nt, Artificial Sequence
  Synthetic
acaccuaagaaauggag

SEQ ID NO: 4568 - RNA, 17 nt, Artificial Sequence
  Synthetic
ggcugucaaggcuggag

SEQ ID NO: 4569 - RNA, 17 nt, Artificial Sequence
  Synthetic
aagggaggaggguggag

SEQ ID NO: 4570 - RNA, 17 nt, Artificial Sequence
  Synthetic
ucugggggggcccugag

SEQ ID NO: 4571 - RNA, 17 nt, Artificial Sequence
  Synthetic
gggugaccaucugugag

SEQ ID NO: 4572 - RNA, 17 nt, Artificial Sequence
  Synthetic
aucagggacagaccuag

SEQ ID NO: 4573 - RNA, 17 nt, Artificial Sequence
  Synthetic
acaggauguugauguag

SEQ ID NO: 4574 - RNA, 17 nt, Artificial Sequence
  Synthetic
uccgcggccccagaacg

SEQ ID NO: 4575 - RNA, 17 nt, Artificial Sequence
  Synthetic
cccgcccccgccucacg

SEQ ID NO: 4576 - RNA, 17 nt, Artificial Sequence
  Synthetic
caccacagacaacaccg

SEQ ID NO: 4577 - RNA, 17 nt, Artificial Sequence
  Synthetic
uaccugggaugucaccg

SEQ ID NO: 4578 - RNA, 17 nt, Artificial Sequence
  Synthetic
ugaggcccgcagcgccg

SEQ ID NO: 4579 - RNA, 17 nt, Artificial Sequence
  Synthetic
uacuggucuccaggccg

SEQ ID NO: 4580 - RNA, 17 nt, Artificial Sequence
  Synthetic
uccacguucuggggccg

SEQ ID NO: 4581 - RNA, 17 nt, Artificial Sequence
  Synthetic
ccuacaucuucuauccg

SEQ ID NO: 4582 - RNA, 17 nt, Artificial Sequence
  Synthetic
ggcccaaccugauuccg

SEQ ID NO: 4583 - RNA, 17 nt, Artificial Sequence
  Synthetic
ccgucgagcccguagcg

SEQ ID NO: 4584 - RNA, 17 nt, Artificial Sequence
  Synthetic
acgggccccgugaggcg

SEQ ID NO: 4585 - RNA, 17 nt, Artificial Sequence
  Synthetic
ggguaccugaaggggcg

SEQ ID NO: 4586 - RNA, 17 nt, Artificial Sequence
  Synthetic
cccccuggagaugggcg

SEQ ID NO: 4587 - RNA, 17 nt, Artificial Sequence
  Synthetic
uaacuugcggccuggcg

SEQ ID NO: 4588 - RNA, 17 nt, Artificial Sequence
  Synthetic
agccgucgcgaccugcg

SEQ ID NO: 4589 - RNA, 17 nt, Artificial Sequence
  Synthetic
cuccuucaccacucucg

SEQ ID NO: 4590 - RNA, 17 nt, Artificial Sequence
  Synthetic
acaucaacauccugucg

SEQ ID NO: 4591 - RNA, 17 nt, Artificial Sequence
  Synthetic
gggcagaagugggaagg

SEQ ID NO: 4592 - RNA, 17 nt, Artificial Sequence
  Synthetic
cccccccagaggacagg

SEQ ID NO: 4593 - RNA, 17 nt, Artificial Sequence
  Synthetic
ugcccagguuggacagg

SEQ ID NO: 4594 - RNA, 17 nt, Artificial Sequence
  Synthetic
ggacaacaacccccagg

SEQ ID NO: 4595 - RNA, 17 nt, Artificial Sequence
  Synthetic
uggugaaacagcccagg

SEQ ID NO: 4596 - RNA, 17 nt, Artificial Sequence
  Synthetic
ccccgcccaucuccagg

SEQ ID NO: 4597 - RNA, 17 nt, Artificial Sequence
  Synthetic
aggguggcauaggcagg

SEQ ID NO: 4598 - RNA, 17 nt, Artificial Sequence
  Synthetic
gggcaggggugcucagg

SEQ ID NO: 4599 - RNA, 17 nt, Artificial Sequence
  Synthetic
uggucuccaggccgagg

SEQ ID NO: 4600 - RNA, 17 nt, Artificial Sequence
  Synthetic
cacaccuggaagggagg

SEQ ID NO: 4601 - RNA, 17 nt, Artificial Sequence
  Synthetic
ucugccaucccuggagg

SEQ ID NO: 4602 - RNA, 17 nt, Artificial Sequence
  Synthetic
cgacgggccccgugagg

SEQ ID NO: 4603 - RNA, 17 nt, Artificial Sequence
  Synthetic
cgggccccgugaggcgg

SEQ ID NO: 4604 - RNA, 17 nt, Artificial Sequence
  Synthetic
ccccuggagaugggcgg

SEQ ID NO: 4605 - RNA, 17 nt, Artificial Sequence
  Synthetic
gccgucgcgaccugcgg

SEQ ID NO: 4606 - RNA, 17 nt, Artificial Sequence
  Synthetic
auacacaccuggaaggg

SEQ ID NO: 4607 - RNA, 17 nt, Artificial Sequence
  Synthetic
ugggcgggggcccaggg

SEQ ID NO: 4608 - RNA, 17 nt, Artificial Sequence
  Synthetic
aggggaggaugccaggg

SEQ ID NO: 4609 - RNA, 17 nt, Artificial Sequence
  Synthetic
agguguggggcagaggg

SEQ ID NO: 4610 - RNA, 17 nt, Artificial Sequence
  Synthetic
ccuggaagggaggaggg

SEQ ID NO: 4611 - RNA, 17 nt, Artificial Sequence
  Synthetic
aguuuccauacaucggg

SEQ ID NO: 4612 - RNA, 17 nt, Artificial Sequence
  Synthetic
gacauacucaucagggg

SEQ ID NO: 4613 - RNA, 17 nt, Artificial Sequence
  Synthetic
gaagugggaaggagggg

SEQ ID NO: 4614 - RNA, 17 nt, Artificial Sequence
  Synthetic
guggcauaggcaggggg

SEQ ID NO: 4615 - RNA, 17 nt, Artificial Sequence
  Synthetic
gccccgugaggcggggg

SEQ ID NO: 4616 - RNA, 17 nt, Artificial Sequence
  Synthetic
aggacagagacaugggg

SEQ ID NO: 4617 - RNA, 17 nt, Artificial Sequence
  Synthetic
ccaccuguccucugggg

SEQ ID NO: 4618 - RNA, 17 nt, Artificial Sequence
  Synthetic
agcccccuggagauggg

SEQ ID NO: 4619 - RNA, 17 nt, Artificial Sequence
  Synthetic
uguggggaagggauggg

SEQ ID NO: 4620 - RNA, 17 nt, Artificial Sequence
  Synthetic
caaggaugcugacuggg

SEQ ID NO: 4621 - RNA, 17 nt, Artificial Sequence
  Synthetic
uccaccuguccucuggg

SEQ ID NO: 4622 - RNA, 17 nt, Artificial Sequence
  Synthetic
uuccuaggaaagaaugg

SEQ ID NO: 4623 - RNA, 17 nt, Artificial Sequence
  Synthetic
gccuuuauggaugaugg

SEQ ID NO: 4624 - RNA, 17 nt, Artificial Sequence
  Synthetic
cuuccucaugcugaugg

SEQ ID NO: 4625 - RNA, 17 nt, Artificial Sequence
  Synthetic
ccuuccaguccaccugg

SEQ ID NO: 4626 - RNA, 17 nt, Artificial Sequence
  Synthetic
gacucugccaucccugg

SEQ ID NO: 4627 - RNA, 17 nt, Artificial Sequence
  Synthetic
guugucccgcaagcugg

SEQ ID NO: 4628 - RNA, 17 nt, Artificial Sequence
  Synthetic
aauuaaagaggagcugg

SEQ ID NO: 4629 - RNA, 17 nt, Artificial Sequence
  Synthetic
cuccaccuguccucugg

SEQ ID NO: 4630 - RNA, 17 nt, Artificial Sequence
  Synthetic
ccccagaggacaggugg

SEQ ID NO: 4631 - RNA, 17 nt, Artificial Sequence
  Synthetic
ggaggaugccagggugg

SEQ ID NO: 4632 - RNA, 17 nt, Artificial Sequence
  Synthetic
uuccauacaucgggugg

SEQ ID NO: 4633 - RNA, 17 nt, Artificial Sequence
  Synthetic
acagagacauggggugg

SEQ ID NO: 4634 - RNA, 17 nt, Artificial Sequence
  Synthetic
ggggaagggaugggugg

SEQ ID NO: 4635 - RNA, 17 nt, Artificial Sequence
  Synthetic
cucgguguugucugugg

SEQ ID NO: 4636 - RNA, 17 nt, Artificial Sequence
  Synthetic
acccuggacagacuugg

SEQ ID NO: 4637 - RNA, 17 nt, Artificial Sequence
  Synthetic
auuccuaggaaagaaug

SEQ ID NO: 4638 - RNA, 17 nt, Artificial Sequence
  Synthetic
acaaggacagagacaug

SEQ ID NO: 4639 - RNA, 17 nt, Artificial Sequence
  Synthetic
accuucggagcagcaug

SEQ ID NO: 4640 - RNA, 17 nt, Artificial Sequence
  Synthetic
agaccuccaucagcaug

SEQ ID NO: 4641 - RNA, 17 nt, Artificial Sequence
  Synthetic
cucaucagggguggaug

SEQ ID NO: 4642 - RNA, 17 nt, Artificial Sequence
  Synthetic
gcgucugcucugugaug

SEQ ID NO: 4643 - RNA, 17 nt, Artificial Sequence
  Synthetic
ugaucucuugguguaug

SEQ ID NO: 4644 - RNA, 17 nt, Artificial Sequence
  Synthetic
ccgggccccagucacug

SEQ ID NO: 4645 - RNA, 17 nt, Artificial Sequence
  Synthetic
gcuguccacagugacug

SEQ ID NO: 4646 - RNA, 17 nt, Artificial Sequence
  Synthetic
uccuuccaguccaccug

SEQ ID NO: 4647 - RNA, 17 nt, Artificial Sequence
  Synthetic
gcagccgucgcgaccug

SEQ ID NO: 4648 - RNA, 17 nt, Artificial Sequence
  Synthetic
auaguagcaguacccug

SEQ ID NO: 4649 - RNA, 17 nt, Artificial Sequence
  Synthetic
gcagccaguggagccug

SEQ ID NO: 4650 - RNA, 17 nt, Artificial Sequence
  Synthetic
accccuugcagcgccug

SEQ ID NO: 4651 - RNA, 17 nt, Artificial Sequence
  Synthetic
agaaagcacaguuccug

SEQ ID NO: 4652 - RNA, 17 nt, Artificial Sequence
  Synthetic
gguagcuggucacgcug

SEQ ID NO: 4653 - RNA, 17 nt, Artificial Sequence
  Synthetic
cgggccccucggcgcug

SEQ ID NO: 4654 - RNA, 17 nt, Artificial Sequence
  Synthetic
gcaggucgcgacggcug

SEQ ID NO: 4655 - RNA, 17 nt, Artificial Sequence
  Synthetic
ccuccaccuguccucug

SEQ ID NO: 4656 - RNA, 17 nt, Artificial Sequence
  Synthetic
acagcccagguggucug

SEQ ID NO: 4657 - RNA, 17 nt, Artificial Sequence
  Synthetic
cuccucgguguugucug

SEQ ID NO: 4658 - RNA, 17 nt, Artificial Sequence
  Synthetic
caguacuccacguucug

SEQ ID NO: 4659 - RNA, 17 nt, Artificial Sequence
  Synthetic
acaucccagguagagug

SEQ ID NO: 4660 - RNA, 17 nt, Artificial Sequence
  Synthetic
agcaugaucaaggagug

SEQ ID NO: 4661 - RNA, 17 nt, Artificial Sequence
  Synthetic
gcucgacgggccccgug

SEQ ID NO: 4662 - RNA, 17 nt, Artificial Sequence
  Synthetic
aguacacacagcaggug

SEQ ID NO: 4663 - RNA, 17 nt, Artificial Sequence
  Synthetic
acuccauuucuuaggug

SEQ ID NO: 4664 - RNA, 17 nt, Artificial Sequence
  Synthetic
cagggguggaugcggug

SEQ ID NO: 4665 - RNA, 17 nt, Artificial Sequence
  Synthetic
aggcgcugcaaggggug

SEQ ID NO: 4666 - RNA, 17 nt, Artificial Sequence
  Synthetic
gacagagacauggggug

SEQ ID NO: 4667 - RNA, 17 nt, Artificial Sequence
  Synthetic
uggggaagggaugggug

SEQ ID NO: 4668 - RNA, 17 nt, Artificial Sequence
  Synthetic
ucggcuuccagcuggug

SEQ ID NO: 4669 - RNA, 17 nt, Artificial Sequence
  Synthetic
aucccagguagagugug

SEQ ID NO: 4670 - RNA, 17 nt, Artificial Sequence
  Synthetic
uccauuucuuaggugug

SEQ ID NO: 4671 - RNA, 17 nt, Artificial Sequence
  Synthetic
augguggcuuuaacuug

SEQ ID NO: 4672 - RNA, 17 nt, Artificial Sequence
  Synthetic
aacccuggacagacuug

SEQ ID NO: 4673 - RNA, 17 nt, Artificial Sequence
  Synthetic
gcguggccuccagcuug

SEQ ID NO: 4674 - RNA, 17 nt, Artificial Sequence
  Synthetic
gugcaaccagaacaaau

SEQ ID NO: 4675 - RNA, 17 nt, Artificial Sequence
  Synthetic
cauuccuaggaaagaau

SEQ ID NO: 4676 - RNA, 17 nt, Artificial Sequence
  Synthetic
agagggagacucagaau

SEQ ID NO: 4677 - RNA, 17 nt, Artificial Sequence
  Synthetic
cauucuuuccuaggaau

SEQ ID NO: 4678 - RNA, 17 nt, Artificial Sequence
  Synthetic
gacaaggacagagacau

SEQ ID NO: 4679 - RNA, 17 nt, Artificial Sequence
  Synthetic
uagcaguuuccauacau

SEQ ID NO: 4680 - RNA, 17 nt, Artificial Sequence
  Synthetic
ggggcccaggguggcau

SEQ ID NO: 4681 - RNA, 17 nt, Artificial Sequence
  Synthetic
gguguauguggguucau

SEQ ID NO: 4682 - RNA, 17 nt, Artificial Sequence
  Synthetic
uggaaggacuggaagau

SEQ ID NO: 4683 - RNA, 17 nt, Artificial Sequence
  Synthetic
cagagcccccuggagau

SEQ ID NO: 4684 - RNA, 17 nt, Artificial Sequence
  Synthetic
agagguacauugacgau

SEQ ID NO: 4685 - RNA, 17 nt, Artificial Sequence
  Synthetic
gaguguggggaagggau

SEQ ID NO: 4686 - RNA, 17 nt, Artificial Sequence
  Synthetic
ggccuggagaccaguau

SEQ ID NO: 4687 - RNA, 17 nt, Artificial Sequence
  Synthetic
gcauggcuuccggcacu

SEQ ID NO: 4688 - RNA, 17 nt, Artificial Sequence
  Synthetic
gaaacccuggacagacu

SEQ ID NO: 4689 - RNA, 17 nt, Artificial Sequence
  Synthetic
aggcaaggaugcugacu

SEQ ID NO: 4690 - RNA, 17 nt, Artificial Sequence
  Synthetic
ugcuguccacagugacu

SEQ ID NO: 4691 - RNA, 17 nt, Artificial Sequence
  Synthetic
acccuccuguccaaccu

SEQ ID NO: 4692 - RNA, 17 nt, Artificial Sequence
  Synthetic
uucuccucagaccaccu

SEQ ID NO: 4693 - RNA, 17 nt, Artificial Sequence
  Synthetic
guccuuccaguccaccu

SEQ ID NO: 4694 - RNA, 17 nt, Artificial Sequence
  Synthetic
gcaucagggacagaccu

SEQ ID NO: 4695 - RNA, 17 nt, Artificial Sequence
  Synthetic
uuccccacacucuaccu

SEQ ID NO: 4696 - RNA, 17 nt, Artificial Sequence
  Synthetic
ccugccuaugccacccu

SEQ ID NO: 4697 - RNA, 17 nt, Artificial Sequence
  Synthetic
gcucucucugcaccccu

SEQ ID NO: 4698 - RNA, 17 nt, Artificial Sequence
  Synthetic
gagcaccccugcccccu

SEQ ID NO: 4699 - RNA, 17 nt, Artificial Sequence
  Synthetic
uuacucacgauggcccu

SEQ ID NO: 4700 - RNA, 17 nt, Artificial Sequence
  Synthetic
ccugugguucggcuccu

SEQ ID NO: 4701 - RNA, 17 nt, Artificial Sequence
  Synthetic
cuggaagacccauuccu

SEQ ID NO: 4702 - RNA, 17 nt, Artificial Sequence
  Synthetic
cagaaagcacaguuccu

SEQ ID NO: 4703 - RNA, 17 nt, Artificial Sequence
  Synthetic
cacccccauucuuuccu

SEQ ID NO: 4704 - RNA, 17 nt, Artificial Sequence
  Synthetic
cuggaggaggacacgcu

SEQ ID NO: 4705 - RNA, 17 nt, Artificial Sequence
  Synthetic
ugguagcuggucacgcu

SEQ ID NO: 4706 - RNA, 17 nt, Artificial Sequence
  Synthetic
gggagcagggccuggcu

SEQ ID NO: 4707 - RNA, 17 nt, Artificial Sequence
  Synthetic
uccuccaccuguccucu

SEQ ID NO: 4708 - RNA, 17 nt, Artificial Sequence
  Synthetic
aacaucacugccauucu

SEQ ID NO: 4709 - RNA, 17 nt, Artificial Sequence
  Synthetic
acaguacuccacguucu

SEQ ID NO: 4710 - RNA, 17 nt, Artificial Sequence
  Synthetic
ggggugggggcagaagu

SEQ ID NO: 4711 - RNA, 17 nt, Artificial Sequence
  Synthetic
ugcagagagagcagagu

SEQ ID NO: 4712 - RNA, 17 nt, Artificial Sequence
  Synthetic
aucaggaaagagagagu

SEQ ID NO: 4713 - RNA, 17 nt, Artificial Sequence
  Synthetic
ccacuggcugcccaggu

SEQ ID NO: 4714 - RNA, 17 nt, Artificial Sequence
  Synthetic
cugccacggaaucaggu

SEQ ID NO: 4715 - RNA, 17 nt, Artificial Sequence
  Synthetic
ggaagacauccagaggu

SEQ ID NO: 4716 - RNA, 17 nt, Artificial Sequence
  Synthetic
ucucccucugucacggu

SEQ ID NO: 4717 - RNA, 17 nt, Artificial Sequence
  Synthetic
gguguggggcagagggu

SEQ ID NO: 4718 - RNA, 17 nt, Artificial Sequence
  Synthetic
ggacagagacauggggu

SEQ ID NO: 4719 - RNA, 17 nt, Artificial Sequence
  Synthetic
guggggaagggaugggu

SEQ ID NO: 4720 - RNA, 17 nt, Artificial Sequence
  Synthetic
ccgcggauagaagaugu

SEQ ID NO: 4721 - RNA, 17 nt, Artificial Sequence
  Synthetic
gaucucuugguguaugu

SEQ ID NO: 4722 - RNA, 17 nt, Artificial Sequence
  Synthetic
uaguagcaguacccugu

SEQ ID NO: 4723 - RNA, 17 nt, Artificial Sequence
  Synthetic
agaaaggugcucagugu

SEQ ID NO: 4724 - RNA, 17 nt, Artificial Sequence
  Synthetic
caucccagguagagugu

SEQ ID NO: 4725 - RNA, 17 nt, Artificial Sequence
  Synthetic
cuccauuucuuaggugu

SEQ ID NO: 4726 - RNA, 17 nt, Artificial Sequence
  Synthetic
aaacccuggacagacuu

SEQ ID NO: 4727 - RNA, 17 nt, Artificial Sequence
  Synthetic
gaagaagauguugacuu

SEQ ID NO: 4728 - RNA, 17 nt, Artificial Sequence
  Synthetic
aucggcuucggaaccuu

SEQ ID NO: 4729 - RNA, 17 nt, Artificial Sequence
  Synthetic
gagaccaguaucggcuu

SEQ ID NO: 4730 - RNA, 17 nt, Artificial Sequence
  Synthetic
uggccacuccauuucuu

SEQ ID NO: 4731 - RNA, 17 nt, Artificial Sequence
  Synthetic
ugccacggaaucagguu

SEQ ID NO: 4732 - RNA, 17 nt, Artificial Sequence
  Synthetic
caguggagccugugguu

SEQ ID NO: 4733 - RNA, 20 nt, Artificial Sequence
  Synthetic
ucugccccacaccuaagaaa

SEQ ID NO: 4734 - RNA, 20 nt, Artificial Sequence
  Synthetic
uccaugccuggaaucaacaa

SEQ ID NO: 4735 - RNA, 20 nt, Artificial Sequence
  Synthetic
gggacccucaggcgcugcaa

SEQ ID NO: 4736 - RNA, 20 nt, Artificial Sequence
  Synthetic
gacccauuccuaggaaagaa

SEQ ID NO: 4737 - RNA, 20 nt, Artificial Sequence
  Synthetic
uauggcgacugcaccaagaa

SEQ ID NO: 4738 - RNA, 20 nt, Artificial Sequence
  Synthetic
gucacgcuggggauggagaa

SEQ ID NO: 4739 - RNA, 20 nt, Artificial Sequence
  Synthetic
cccccauucuuuccuaggaa

SEQ ID NO: 4740 - RNA, 20 nt, Artificial Sequence
  Synthetic
cccagguagaguguggggaa

SEQ ID NO: 4741 - RNA, 20 nt, Artificial Sequence
  Synthetic
gagugaauacacaccuggaa

SEQ ID NO: 4742 - RNA, 20 nt, Artificial Sequence
  Synthetic
uuaauuuccggguaccugaa

SEQ ID NO: 4743 - RNA, 20 nt, Artificial Sequence
  Synthetic
ccugcuguguguacuuugaa

SEQ ID NO: 4744 - RNA, 20 nt, Artificial Sequence
  Synthetic
aaagccaccaucauccauaa

SEQ ID NO: 4745 - RNA, 20 nt, Artificial Sequence
  Synthetic
guguguacuuugaaggguaa

SEQ ID NO: 4746 - RNA, 20 nt, Artificial Sequence
  Synthetic
agugacuggggcccggguaa

SEQ ID NO: 4747 - RNA, 20 nt, Artificial Sequence
  Synthetic
ggcaucucucuguacccaca

SEQ ID NO: 4748 - RNA, 20 nt, Artificial Sequence
  Synthetic
cugggacaaggacagagaca

SEQ ID NO: 4749 - RNA, 20 nt, Artificial Sequence
  Synthetic
agcagggccuggcugggaca

SEQ ID NO: 4750 - RNA, 20 nt, Artificial Sequence
  Synthetic
aggagagguuucucacacca

SEQ ID NO: 4751 - RNA, 20 nt, Artificial Sequence
  Synthetic
uggagaugggcgggggccca

SEQ ID NO: 4752 - RNA, 20 nt, Artificial Sequence
  Synthetic
ggaaggaggggaggaugcca

SEQ ID NO: 4753 - RNA, 20 nt, Artificial Sequence
  Synthetic
guuccuggggugagacucca

SEQ ID NO: 4754 - RNA, 20 nt, Artificial Sequence
  Synthetic
gcccagcguguccuccucca

SEQ ID NO: 4755 - RNA, 20 nt, Artificial Sequence
  Synthetic
gaagcucccugcuugcucca

SEQ ID NO: 4756 - RNA, 20 nt, Artificial Sequence
  Synthetic
ugggcccccgcccaucucca

SEQ ID NO: 4757 - RNA, 20 nt, Artificial Sequence
  Synthetic
aucgcccccaagucugucca

SEQ ID NO: 4758 - RNA, 20 nt, Artificial Sequence
  Synthetic
agggcgccauggagcaagca

SEQ ID NO: 4759 - RNA, 20 nt, Artificial Sequence
  Synthetic
cccagucacuguggacagca

SEQ ID NO: 4760 - RNA, 20 nt, Artificial Sequence
  Synthetic
ucaaggcuggagagggagca

SEQ ID NO: 4761 - RNA, 20 nt, Artificial Sequence
  Synthetic
ccaucagcaugaggaaggca

SEQ ID NO: 4762 - RNA, 20 nt, Artificial Sequence
  Synthetic
accguuguugauuccaggca

SEQ ID NO: 4763 - RNA, 20 nt, Artificial Sequence
  Synthetic
ggcccaggguggcauaggca

SEQ ID NO: 4764 - RNA, 20 nt, Artificial Sequence
  Synthetic
gucuccaggccgagggggca

SEQ ID NO: 4765 - RNA, 20 nt, Artificial Sequence
  Synthetic
gaaggggacacuaaccugca

SEQ ID NO: 4766 - RNA, 20 nt, Artificial Sequence
  Synthetic
cgggacccucaggcgcugca

SEQ ID NO: 4767 - RNA, 20 nt, Artificial Sequence
  Synthetic
caucuccagggggcucugca

SEQ ID NO: 4768 - RNA, 20 nt, Artificial Sequence
  Synthetic
ggggcccggguaauggugca

SEQ ID NO: 4769 - RNA, 20 nt, Artificial Sequence
  Synthetic
cugcucugcgcgcagcauca

SEQ ID NO: 4770 - RNA, 20 nt, Artificial Sequence
  Synthetic
ucuaccagacauacucauca

SEQ ID NO: 4771 - RNA, 20 nt, Artificial Sequence
  Synthetic
aaagaaugggggugucauca

SEQ ID NO: 4772 - RNA, 20 nt, Artificial Sequence
  Synthetic
cuuccaggagagcaugauca

SEQ ID NO: 4773 - RNA, 20 nt, Artificial Sequence
  Synthetic
agggucccgcccccgccuca

SEQ ID NO: 4774 - RNA, 20 nt, Artificial Sequence
  Synthetic
aaaccucuccuucccucuca

SEQ ID NO: 4775 - RNA, 20 nt, Artificial Sequence
  Synthetic
ggcagggggaggggcuguca

SEQ ID NO: 4776 - RNA, 20 nt, Artificial Sequence
  Synthetic
uucugagucucccucuguca

SEQ ID NO: 4777 - RNA, 20 nt, Artificial Sequence
  Synthetic
caaagucaacaucuucuuca

SEQ ID NO: 4778 - RNA, 20 nt, Artificial Sequence
  Synthetic
cugaaggggcgaggggaaga

SEQ ID NO: 4779 - RNA, 20 nt, Artificial Sequence
  Synthetic
uguaccucuccucucacaga

SEQ ID NO: 4780 - RNA, 20 nt, Artificial Sequence
  Synthetic
gcacgaccuaccgugacaga

SEQ ID NO: 4781 - RNA, 20 nt, Artificial Sequence
  Synthetic
uuucuuagguguggggcaga

SEQ ID NO: 4782 - RNA, 20 nt, Artificial Sequence
  Synthetic
acacagagacuagagucaga

SEQ ID NO: 4783 - RNA, 20 nt, Artificial Sequence
  Synthetic
ggaggaggguggagaggaga

SEQ ID NO: 4784 - RNA, 20 nt, Artificial Sequence
  Synthetic
ccugcagagcccccuggaga

SEQ ID NO: 4785 - RNA, 20 nt, Artificial Sequence
  Synthetic
ggggcugucaaggcuggaga

SEQ ID NO: 4786 - RNA, 20 nt, Artificial Sequence
  Synthetic
gguguugucugugguggaga

SEQ ID NO: 4787 - RNA, 20 nt, Artificial Sequence
  Synthetic
ccucugggggggcccugaga

SEQ ID NO: 4788 - RNA, 20 nt, Artificial Sequence
  Synthetic
ucucugcugguuacucacga

SEQ ID NO: 4789 - RNA, 20 nt, Artificial Sequence
  Synthetic
gaggagagguacauugacga

SEQ ID NO: 4790 - RNA, 20 nt, Artificial Sequence
  Synthetic
ucuaccugggaugucaccga

SEQ ID NO: 4791 - RNA, 20 nt, Artificial Sequence
  Synthetic
ggugaggcccgcagcgccga

SEQ ID NO: 4792 - RNA, 20 nt, Artificial Sequence
  Synthetic
gauacuggucuccaggccga

SEQ ID NO: 4793 - RNA, 20 nt, Artificial Sequence
  Synthetic
uguuccucaugcugcuccga

SEQ ID NO: 4794 - RNA, 20 nt, Artificial Sequence
  Synthetic
gagucccccgcaggucgcga

SEQ ID NO: 4795 - RNA, 20 nt, Artificial Sequence
  Synthetic
ccggguaccugaaggggcga

SEQ ID NO: 4796 - RNA, 20 nt, Artificial Sequence
  Synthetic
aggccacgcuacgggcucga

SEQ ID NO: 4797 - RNA, 20 nt, Artificial Sequence
  Synthetic
gggggcagaagugggaagga

SEQ ID NO: 4798 - RNA, 20 nt, Artificial Sequence
  Synthetic
gcugcccagguuggacagga

SEQ ID NO: 4799 - RNA, 20 nt, Artificial Sequence
  Synthetic
uacacaccuggaagggagga

SEQ ID NO: 4800 - RNA, 20 nt, Artificial Sequence
  Synthetic
gaccuccaucagcaugagga

SEQ ID NO: 4801 - RNA, 20 nt, Artificial Sequence
  Synthetic
gguagaguguggggaaggga

SEQ ID NO: 4802 - RNA, 20 nt, Artificial Sequence
  Synthetic
agcguguccuccuccaggga

SEQ ID NO: 4803 - RNA, 20 nt, Artificial Sequence
  Synthetic
ugggggggcccugagaggga

SEQ ID NO: 4804 - RNA, 20 nt, Artificial Sequence
  Synthetic
ggguggcauaggcaggggga

SEQ ID NO: 4805 - RNA, 20 nt, Artificial Sequence
  Synthetic
guagcuggucacgcugggga

SEQ ID NO: 4806 - RNA, 20 nt, Artificial Sequence
  Synthetic
ucccagguagagugugggga

SEQ ID NO: 4807 - RNA, 20 nt, Artificial Sequence
  Synthetic
gggugggggcagaaguggga

SEQ ID NO: 4808 - RNA, 20 nt, Artificial Sequence
  Synthetic
caacccccagguggacugga

SEQ ID NO: 4809 - RNA, 20 nt, Artificial Sequence
  Synthetic
ggagugaauacacaccugga

SEQ ID NO: 4810 - RNA, 20 nt, Artificial Sequence
  Synthetic
ugcugacugggaggccugga

SEQ ID NO: 4811 - RNA, 20 nt, Artificial Sequence
  Synthetic
cacgguaggucgugccugga

SEQ ID NO: 4812 - RNA, 20 nt, Artificial Sequence
  Synthetic
gaaccugccuuuauggauga

SEQ ID NO: 4813 - RNA, 20 nt, Artificial Sequence
  Synthetic
uuuaauuuccggguaccuga

SEQ ID NO: 4814 - RNA, 20 nt, Artificial Sequence
  Synthetic
gcaccccuugcagcgccuga

SEQ ID NO: 4815 - RNA, 20 nt, Artificial Sequence
  Synthetic
ccuugccuuccucaugcuga

SEQ ID NO: 4816 - RNA, 20 nt, Artificial Sequence
  Synthetic
aucagggguggaugcgguga

SEQ ID NO: 4817 - RNA, 20 nt, Artificial Sequence
  Synthetic
gccggccacgagagugguga

SEQ ID NO: 4818 - RNA, 20 nt, Artificial Sequence
  Synthetic
gacugaccucuuguuguuga

SEQ ID NO: 4819 - RNA, 20 nt, Artificial Sequence
  Synthetic
accugcuguguguacuuuga

SEQ ID NO: 4820 - RNA, 20 nt, Artificial Sequence
  Synthetic
cuacucucucuuuccugaua

SEQ ID NO: 4821 - RNA, 20 nt, Artificial Sequence
  Synthetic
cagcaucagggacagaccua

SEQ ID NO: 4822 - RNA, 20 nt, Artificial Sequence
  Synthetic
gcaagcuggaggccacgcua

SEQ ID NO: 4823 - RNA, 20 nt, Artificial Sequence
  Synthetic
uuaucaggaaagagagagua

SEQ ID NO: 4824 - RNA, 20 nt, Artificial Sequence
  Synthetic
cacuuccaccacccgaugua

SEQ ID NO: 4825 - RNA, 20 nt, Artificial Sequence
  Synthetic
gacagacuugggggcgauua

SEQ ID NO: 4826 - RNA, 20 nt, Artificial Sequence
  Synthetic
gcaggaugaaccugccuuua

SEQ ID NO: 4827 - RNA, 20 nt, Artificial Sequence
  Synthetic
gaaggguaaagguucucaac

SEQ ID NO: 4828 - RNA, 20 nt, Artificial Sequence
  Synthetic
cagaggacagguggaggaac

SEQ ID NO: 4829 - RNA, 20 nt, Artificial Sequence
  Synthetic
acaccgaggagccgaaccac

SEQ ID NO: 4830 - RNA, 20 nt, Artificial Sequence
  Synthetic
aggcaucucucuguacccac

SEQ ID NO: 4831 - RNA, 20 nt, Artificial Sequence
  Synthetic
agccgaaccacaggcuccac

SEQ ID NO: 4832 - RNA, 20 nt, Artificial Sequence
  Synthetic
gggcccggguaauggugcac

SEQ ID NO: 4833 - RNA, 20 nt, Artificial Sequence
  Synthetic
ccgauuuguucugguugcac

SEQ ID NO: 4834 - RNA, 20 nt, Artificial Sequence
  Synthetic
gggucccgcccccgccucac

SEQ ID NO: 4835 - RNA, 20 nt, Artificial Sequence
  Synthetic
gagucucuggcagccucgac

SEQ ID NO: 4836 - RNA, 20 nt, Artificial Sequence
  Synthetic
ggccacgcuacgggcucgac

SEQ ID NO: 4837 - RNA, 20 nt, Artificial Sequence
  Synthetic
cccagguggacuggaaggac

SEQ ID NO: 4838 - RNA, 20 nt, Artificial Sequence
  Synthetic
ucagggcccccccagaggac

SEQ ID NO: 4839 - RNA, 20 nt, Artificial Sequence
  Synthetic
acaacaacccccagguggac

SEQ ID NO: 4840 - RNA, 20 nt, Artificial Sequence
  Synthetic
acuggcugcccagguuggac

SEQ ID NO: 4841 - RNA, 20 nt, Artificial Sequence
  Synthetic
aggaaggcaaggaugcugac

SEQ ID NO: 4842 - RNA, 20 nt, Artificial Sequence
  Synthetic
ccccugcuguccacagugac

SEQ ID NO: 4843 - RNA, 20 nt, Artificial Sequence
  Synthetic
gaagguuccgaagccgauac

SEQ ID NO: 4844 - RNA, 20 nt, Artificial Sequence
  Synthetic
caagcuggaggccacgcuac

SEQ ID NO: 4845 - RNA, 20 nt, Artificial Sequence
  Synthetic
guguccccuuccccggguac

SEQ ID NO: 4846 - RNA, 20 nt, Artificial Sequence
  Synthetic
ugaaggagcuguauuuguac

SEQ ID NO: 4847 - RNA, 20 nt, Artificial Sequence
  Synthetic
ggucacccuccuguccaacc

SEQ ID NO: 4848 - RNA, 20 nt, Artificial Sequence
  Synthetic
caaccaggucuccugcaacc

SEQ ID NO: 4849 - RNA, 20 nt, Artificial Sequence
  Synthetic
ggucugaggagaagucaacc

SEQ ID NO: 4850 - RNA, 20 nt, Artificial Sequence
  Synthetic
cuucgccugccgcuucaacc

SEQ ID NO: 4851 - RNA, 20 nt, Artificial Sequence
  Synthetic
agcaggagugaauacacacc

SEQ ID NO: 4852 - RNA, 20 nt, Artificial Sequence
  Synthetic
ugacuucuccucagaccacc

SEQ ID NO: 4853 - RNA, 20 nt, Artificial Sequence
  Synthetic
uccaguccuuccaguccacc

SEQ ID NO: 4854 - RNA, 20 nt, Artificial Sequence
  Synthetic
acgccugguugcaggagacc

SEQ ID NO: 4855 - RNA, 20 nt, Artificial Sequence
  Synthetic
ucccuuccccacacucuacc

SEQ ID NO: 4856 - RNA, 20 nt, Artificial Sequence
  Synthetic
cccucgccccuucagguacc

SEQ ID NO: 4857 - RNA, 20 nt, Artificial Sequence
  Synthetic
ccugcccgugcaccauuacc

SEQ ID NO: 4858 - RNA, 20 nt, Artificial Sequence
  Synthetic
uguggguucauaggaaaccc

SEQ ID NO: 4859 - RNA, 20 nt, Artificial Sequence
  Synthetic
ucccccugccuaugccaccc

SEQ ID NO: 4860 - RNA, 20 nt, Artificial Sequence
  Synthetic
ucaggagguagccuccaccc

SEQ ID NO: 4861 - RNA, 20 nt, Artificial Sequence
  Synthetic
cugcccgugcaccauuaccc

SEQ ID NO: 4862 - RNA, 20 nt, Artificial Sequence
  Synthetic
gcucccuggagucucacccc

SEQ ID NO: 4863 - RNA, 20 nt, Artificial Sequence
  Synthetic
cuugcgggacaacaaccccc

SEQ ID NO: 4864 - RNA, 20 nt, Artificial Sequence
  Synthetic
cuggccccugcagagccccc

SEQ ID NO: 4865 - RNA, 20 nt, Artificial Sequence
  Synthetic
agguuaguguccccuucccc

SEQ ID NO: 4866 - RNA, 20 nt, Artificial Sequence
  Synthetic
ggcacuuggugaaacagccc

SEQ ID NO: 4867 - RNA, 20 nt, Artificial Sequence
  Synthetic
cuggagaugggcgggggccc

SEQ ID NO: 4868 - RNA, 20 nt, Artificial Sequence
  Synthetic
guccacagugacuggggccc

SEQ ID NO: 4869 - RNA, 20 nt, Artificial Sequence
  Synthetic
acaagaggucaguccugccc

SEQ ID NO: 4870 - RNA, 20 nt, Artificial Sequence
  Synthetic
acaggcuccacuggcugccc

SEQ ID NO: 4871 - RNA, 20 nt, Artificial Sequence
  Synthetic
auggcccucggugacauccc

SEQ ID NO: 4872 - RNA, 20 nt, Artificial Sequence
  Synthetic
gccagagacucugccauccc

SEQ ID NO: 4873 - RNA, 20 nt, Artificial Sequence
  Synthetic
cagguuaguguccccuuccc

SEQ ID NO: 4874 - RNA, 20 nt, Artificial Sequence
  Synthetic
ucucuguccuugucccagcc

SEQ ID NO: 4875 - RNA, 20 nt, Artificial Sequence
  Synthetic
cugauggaggucuccacgcc

SEQ ID NO: 4876 - RNA, 20 nt, Artificial Sequence
  Synthetic
aggcaggacugacucacgcc

SEQ ID NO: 4877 - RNA, 20 nt, Artificial Sequence
  Synthetic
aggaugcugacugggaggcc

SEQ ID NO: 4878 - RNA, 20 nt, Artificial Sequence
  Synthetic
gguggcuuuaacuugcggcc

SEQ ID NO: 4879 - RNA, 20 nt, Artificial Sequence
  Synthetic
gcaccccugcccccucggcc

SEQ ID NO: 4880 - RNA, 20 nt, Artificial Sequence
  Synthetic
gcuggagagggagcagggcc

SEQ ID NO: 4881 - RNA, 20 nt, Artificial Sequence
  Synthetic
uguccacagugacuggggcc

SEQ ID NO: 4882 - RNA, 20 nt, Artificial Sequence
  Synthetic
cucuggaugucuuccaugcc

SEQ ID NO: 4883 - RNA, 20 nt, Artificial Sequence
  Synthetic
gggaaggaggggaggaugcc

SEQ ID NO: 4884 - RNA, 20 nt, Artificial Sequence
  Synthetic
aggcgugagucaguccugcc

SEQ ID NO: 4885 - RNA, 20 nt, Artificial Sequence
  Synthetic
cugucacgguaggucgugcc

SEQ ID NO: 4886 - RNA, 20 nt, Artificial Sequence
  Synthetic
aguuccuggggugagacucc

SEQ ID NO: 4887 - RNA, 20 nt, Artificial Sequence
  Synthetic
ugcccagcguguccuccucc

SEQ ID NO: 4888 - RNA, 20 nt, Artificial Sequence
  Synthetic
guacugcuacuauaagcucc

SEQ ID NO: 4889 - RNA, 20 nt, Artificial Sequence
  Synthetic
cugggcccccgcccaucucc

SEQ ID NO: 4890 - RNA, 20 nt, Artificial Sequence
  Synthetic
acuccuugaucaugcucucc

SEQ ID NO: 4891 - RNA, 20 nt, Artificial Sequence
  Synthetic
cgaagccgauacuggucucc

SEQ ID NO: 4892 - RNA, 20 nt, Artificial Sequence
  Synthetic
aaucgcccccaagucugucc

SEQ ID NO: 4893 - RNA, 20 nt, Artificial Sequence
  Synthetic
uucucaccguuguugauucc

SEQ ID NO: 4894 - RNA, 20 nt, Artificial Sequence
  Synthetic
ucuccacccuccucccuucc

SEQ ID NO: 4895 - RNA, 20 nt, Artificial Sequence
  Synthetic
guguauucacuccugcuucc

SEQ ID NO: 4896 - RNA, 20 nt, Artificial Sequence
  Synthetic
acuacagaaagcacaguucc

SEQ ID NO: 4897 - RNA, 20 nt, Artificial Sequence
  Synthetic
ccagcuccucuuuaauuucc

SEQ ID NO: 4898 - RNA, 20 nt, Artificial Sequence
  Synthetic
gagggcgccauggagcaagc

SEQ ID NO: 4899 - RNA, 20 nt, Artificial Sequence
  Synthetic
gggguuguugucccgcaagc

SEQ ID NO: 4900 - RNA, 20 nt, Artificial Sequence
  Synthetic
gaucaugcucuccuggaagc

SEQ ID NO: 4901 - RNA, 20 nt, Artificial Sequence
  Synthetic
cccuucaaaguacacacagc

SEQ ID NO: 4902 - RNA, 20 nt, Artificial Sequence
  Synthetic
ccccagucacuguggacagc

SEQ ID NO: 4903 - RNA, 20 nt, Artificial Sequence
  Synthetic
gcgcugcgggccucaccagc

SEQ ID NO: 4904 - RNA, 20 nt, Artificial Sequence
  Synthetic
ugaggaacaugaugaccagc

SEQ ID NO: 4905 - RNA, 20 nt, Artificial Sequence
  Synthetic
cuggaagaucggcuuccagc

SEQ ID NO: 4906 - RNA, 20 nt, Artificial Sequence
  Synthetic
gugaguaaccagcagagagc

SEQ ID NO: 4907 - RNA, 20 nt, Artificial Sequence
  Synthetic
cccggaaauuaaagaggagc

SEQ ID NO: 4908 - RNA, 20 nt, Artificial Sequence
  Synthetic
uaaagaggagcuggaggagc

SEQ ID NO: 4909 - RNA, 20 nt, Artificial Sequence
  Synthetic
gucaaggcuggagagggagc

SEQ ID NO: 4910 - RNA, 20 nt, Artificial Sequence
  Synthetic
gucgcgacggcugcgggagc

SEQ ID NO: 4911 - RNA, 20 nt, Artificial Sequence
  Synthetic
accagcagagagcugguagc

SEQ ID NO: 4912 - RNA, 20 nt, Artificial Sequence
  Synthetic
aucccuggaggaggacacgc

SEQ ID NO: 4913 - RNA, 20 nt, Artificial Sequence
  Synthetic
gagcugguagcuggucacgc

SEQ ID NO: 4914 - RNA, 20 nt, Artificial Sequence
  Synthetic
ggugcggcagagucccccgc

SEQ ID NO: 4915 - RNA, 20 nt, Artificial Sequence
  Synthetic
ccaccaucauccauaaaggc

SEQ ID NO: 4916 - RNA, 20 nt, Artificial Sequence
  Synthetic
gggggaggggcugucaaggc

SEQ ID NO: 4917 - RNA, 20 nt, Artificial Sequence
  Synthetic
cucgacgggccccgugaggc

SEQ ID NO: 4918 - RNA, 20 nt, Artificial Sequence
  Synthetic
gggcccaggguggcauaggc

SEQ ID NO: 4919 - RNA, 20 nt, Artificial Sequence
  Synthetic
ggagaccugguugaagcggc

SEQ ID NO: 4920 - RNA, 20 nt, Artificial Sequence
  Synthetic
cuuguggcugggaccagggc

SEQ ID NO: 4921 - RNA, 20 nt, Artificial Sequence
  Synthetic
ccggguaauggugcacgggc

SEQ ID NO: 4922 - RNA, 20 nt, Artificial Sequence
  Synthetic
ggucuccaggccgagggggc

SEQ ID NO: 4923 - RNA, 20 nt, Artificial Sequence
  Synthetic
gggccccgugaggcgggggc

SEQ ID NO: 4924 - RNA, 20 nt, Artificial Sequence
  Synthetic
agagcccccuggagaugggc

SEQ ID NO: 4925 - RNA, 20 nt, Artificial Sequence
  Synthetic
gagagggagcagggccuggc

SEQ ID NO: 4926 - RNA, 20 nt, Artificial Sequence
  Synthetic
uccuucaccacucucguggc

SEQ ID NO: 4927 - RNA, 20 nt, Artificial Sequence
  Synthetic
ccaagugccggaagccaugc

SEQ ID NO: 4928 - RNA, 20 nt, Artificial Sequence
  Synthetic
ccgcagccgucgcgaccugc

SEQ ID NO: 4929 - RNA, 20 nt, Artificial Sequence
  Synthetic
ugagcucgucuuugaccugc

SEQ ID NO: 4930 - RNA, 20 nt, Artificial Sequence
  Synthetic
ggcgggccccucggcgcugc

SEQ ID NO: 4931 - RNA, 20 nt, Artificial Sequence
  Synthetic
ccgcaggucgcgacggcugc

SEQ ID NO: 4932 - RNA, 20 nt, Artificial Sequence
  Synthetic
ccaucuccagggggcucugc

SEQ ID NO: 4933 - RNA, 20 nt, Artificial Sequence
  Synthetic
accagcuaccagcucucugc

SEQ ID NO: 4934 - RNA, 20 nt, Artificial Sequence
  Synthetic
ugggcuguuucaccaagugc

SEQ ID NO: 4935 - RNA, 20 nt, Artificial Sequence
  Synthetic
uagcguggccuccagcuugc

SEQ ID NO: 4936 - RNA, 20 nt, Artificial Sequence
  Synthetic
acugacucacgccugguugc

SEQ ID NO: 4937 - RNA, 20 nt, Artificial Sequence
  Synthetic
uauagcaguuuccauacauc

SEQ ID NO: 4938 - RNA, 20 nt, Artificial Sequence
  Synthetic
ucugcucugcgcgcagcauc

SEQ ID NO: 4939 - RNA, 20 nt, Artificial Sequence
  Synthetic
uguucugucgcgauagcauc

SEQ ID NO: 4940 - RNA, 20 nt, Artificial Sequence
  Synthetic
uucuaccagacauacucauc

SEQ ID NO: 4941 - RNA, 20 nt, Artificial Sequence
  Synthetic
agugagaguaauuccuuauc

SEQ ID NO: 4942 - RNA, 20 nt, Artificial Sequence
  Synthetic
acaagaacaacuccaaccuc

SEQ ID NO: 4943 - RNA, 20 nt, Artificial Sequence
  Synthetic
gaggcgggggcgggacccuc

SEQ ID NO: 4944 - RNA, 20 nt, Artificial Sequence
  Synthetic
caguuccuccaccuguccuc

SEQ ID NO: 4945 - RNA, 20 nt, Artificial Sequence
  Synthetic
ccgagggggcaggggugcuc

SEQ ID NO: 4946 - RNA, 20 nt, Artificial Sequence
  Synthetic
gaaaccucuccuucccucuc

SEQ ID NO: 4947 - RNA, 20 nt, Artificial Sequence
  Synthetic
uccagggauggcagagucuc

SEQ ID NO: 4948 - RNA, 20 nt, Artificial Sequence
  Synthetic
ggggcgaggggaagaggguc

SEQ ID NO: 4949 - RNA, 20 nt, Artificial Sequence
  Synthetic
ccaccccugaugaguauguc

SEQ ID NO: 4950 - RNA, 20 nt, Artificial Sequence
  Synthetic
ccucuuccccucgccccuuc

SEQ ID NO: 4951 - RNA, 20 nt, Artificial Sequence
  Synthetic
acacuaaccugcauggcuuc

SEQ ID NO: 4952 - RNA, 20 nt, Artificial Sequence
  Synthetic
agucacaguacuccacguuc

SEQ ID NO: 4953 - RNA, 20 nt, Artificial Sequence
  Synthetic
agaagcaguccgauuuguuc

SEQ ID NO: 4954 - RNA, 20 nt, Artificial Sequence
  Synthetic
uccagcuccucuuuaauuuc

SEQ ID NO: 4955 - RNA, 20 nt, Artificial Sequence
  Synthetic
cagguacccggaaauuaaag

SEQ ID NO: 4956 - RNA, 20 nt, Artificial Sequence
  Synthetic
auuacaccgucaacaacaag

SEQ ID NO: 4957 - RNA, 20 nt, Artificial Sequence
  Synthetic
ggacccucaggcgcugcaag

SEQ ID NO: 4958 - RNA, 20 nt, Artificial Sequence
  Synthetic
acauggggugggggcagaag

SEQ ID NO: 4959 - RNA, 20 nt, Artificial Sequence
  Synthetic
ccugaaggggcgaggggaag

SEQ ID NO: 4960 - RNA, 20 nt, Artificial Sequence
  Synthetic
ggauguugauguaguggaag

SEQ ID NO: 4961 - RNA, 20 nt, Artificial Sequence
  Synthetic
uaauuuccggguaccugaag

SEQ ID NO: 4962 - RNA, 20 nt, Artificial Sequence
  Synthetic
ugcaggagaccugguugaag

SEQ ID NO: 4963 - RNA, 20 nt, Artificial Sequence
  Synthetic
ggcacgaccuaccgugacag

SEQ ID NO: 4964 - RNA, 20 nt, Artificial Sequence
  Synthetic
cccucucagggcccccccag

SEQ ID NO: 4965 - RNA, 20 nt, Artificial Sequence
  Synthetic
uguccaaccugggcagccag

SEQ ID NO: 4966 - RNA, 20 nt, Artificial Sequence
  Synthetic
caggcauggaagacauccag

SEQ ID NO: 4967 - RNA, 20 nt, Artificial Sequence
  Synthetic
gggcccccgcccaucuccag

SEQ ID NO: 4968 - RNA, 20 nt, Artificial Sequence
  Synthetic
ccagucacuguggacagcag

SEQ ID NO: 4969 - RNA, 20 nt, Artificial Sequence
  Synthetic
gcccaggguggcauaggcag

SEQ ID NO: 4970 - RNA, 20 nt, Artificial Sequence
  Synthetic
ucuccaggccgagggggcag

SEQ ID NO: 4971 - RNA, 20 nt, Artificial Sequence
  Synthetic
auuucuuagguguggggcag

SEQ ID NO: 4972 - RNA, 20 nt, Artificial Sequence
  Synthetic
aucuccagggggcucugcag

SEQ ID NO: 4973 - RNA, 20 nt, Artificial Sequence
  Synthetic
cuaccagacauacucaucag

SEQ ID NO: 4974 - RNA, 20 nt, Artificial Sequence
  Synthetic
gacacagagacuagagucag

SEQ ID NO: 4975 - RNA, 20 nt, Artificial Sequence
  Synthetic
cacagagacuagagucagag

SEQ ID NO: 4976 - RNA, 20 nt, Artificial Sequence
  Synthetic
gcgggagccggccacgagag

SEQ ID NO: 4977 - RNA, 20 nt, Artificial Sequence
  Synthetic
gugaggcccgcagcgccgag

SEQ ID NO: 4978 - RNA, 20 nt, Artificial Sequence
  Synthetic
auacuggucuccaggccgag

SEQ ID NO: 4979 - RNA, 20 nt, Artificial Sequence
  Synthetic
cggguaccugaaggggcgag

SEQ ID NO: 4980 - RNA, 20 nt, Artificial Sequence
  Synthetic
gggcccugagagggaaggag

SEQ ID NO: 4981 - RNA, 20 nt, Artificial Sequence
  Synthetic
ggggcagaagugggaaggag

SEQ ID NO: 4982 - RNA, 20 nt, Artificial Sequence
  Synthetic
gggaggaggguggagaggag

SEQ ID NO: 4983 - RNA, 20 nt, Artificial Sequence
  Synthetic
gugaccaucugugagaggag

SEQ ID NO: 4984 - RNA, 20 nt, Artificial Sequence
  Synthetic
ggguggaugcggugagggag

SEQ ID NO: 4985 - RNA, 20 nt, Artificial Sequence
  Synthetic
gguggcauaggcagggggag

SEQ ID NO: 4986 - RNA, 20 nt, Artificial Sequence
  Synthetic
cccacaccuaagaaauggag

SEQ ID NO: 4987 - RNA, 20 nt, Artificial Sequence
  Synthetic
aggggcugucaaggcuggag

SEQ ID NO: 4988 - RNA, 20 nt, Artificial Sequence
  Synthetic
uggaagggaggaggguggag

SEQ ID NO: 4989 - RNA, 20 nt, Artificial Sequence
  Synthetic
uccucugggggggcccugag

SEQ ID NO: 4990 - RNA, 20 nt, Artificial Sequence
  Synthetic
ggagggugaccaucugugag

SEQ ID NO: 4991 - RNA, 20 nt, Artificial Sequence
  Synthetic
agcaucagggacagaccuag

SEQ ID NO: 4992 - RNA, 20 nt, Artificial Sequence
  Synthetic
ucgacaggauguugauguag

SEQ ID NO: 4993 - RNA, 20 nt, Artificial Sequence
  Synthetic
cuauccgcggccccagaacg

SEQ ID NO: 4994 - RNA, 20 nt, Artificial Sequence
  Synthetic
ggucccgcccccgccucacg

SEQ ID NO: 4995 - RNA, 20 nt, Artificial Sequence
  Synthetic
cuccaccacagacaacaccg

SEQ ID NO: 4996 - RNA, 20 nt, Artificial Sequence
  Synthetic
cucuaccugggaugucaccg

SEQ ID NO: 4997 - RNA, 20 nt, Artificial Sequence
  Synthetic
uggugaggcccgcagcgccg

SEQ ID NO: 4998 - RNA, 20 nt, Artificial Sequence
  Synthetic
cgauacuggucuccaggccg

SEQ ID NO: 4999 - RNA, 20 nt, Artificial Sequence
  Synthetic
uacuccacguucuggggccg

SEQ ID NO: 5000 - RNA, 20 nt, Artificial Sequence
  Synthetic
gugccuacaucuucuauccg

SEQ ID NO: 5001 - RNA, 20 nt, Artificial Sequence
  Synthetic
ugaggcccaaccugauuccg

SEQ ID NO: 5002 - RNA, 20 nt, Artificial Sequence
  Synthetic
ggcccgucgagcccguagcg

SEQ ID NO: 5003 - RNA, 20 nt, Artificial Sequence
  Synthetic
ucgacgggccccgugaggcg

SEQ ID NO: 5004 - RNA, 20 nt, Artificial Sequence
  Synthetic
uccggguaccugaaggggcg

SEQ ID NO: 5005 - RNA, 20 nt, Artificial Sequence
  Synthetic
gagcccccuggagaugggcg

SEQ ID NO: 5006 - RNA, 20 nt, Artificial Sequence
  Synthetic
cuuuaacuugcggccuggcg

SEQ ID NO: 5007 - RNA, 20 nt, Artificial Sequence
  Synthetic
cgcagccgucgcgaccugcg

SEQ ID NO: 5008 - RNA, 20 nt, Artificial Sequence
  Synthetic
cagcuccuucaccacucucg

SEQ ID NO: 5009 - RNA, 20 nt, Artificial Sequence
  Synthetic
acuacaucaacauccugucg

SEQ ID NO: 5010 - RNA, 20 nt, Artificial Sequence
  Synthetic
ugggggcagaagugggaagg

SEQ ID NO: 5011 - RNA, 20 nt, Artificial Sequence
  Synthetic
gggcccccccagaggacagg

SEQ ID NO: 5012 - RNA, 20 nt, Artificial Sequence
  Synthetic
ggcugcccagguuggacagg

SEQ ID NO: 5013 - RNA, 20 nt, Artificial Sequence
  Synthetic
gcgggacaacaacccccagg

SEQ ID NO: 5014 - RNA, 20 nt, Artificial Sequence
  Synthetic
acuuggugaaacagcccagg

SEQ ID NO: 5015 - RNA, 20 nt, Artificial Sequence
  Synthetic
ggcccccgcccaucuccagg

SEQ ID NO: 5016 - RNA, 20 nt, Artificial Sequence
  Synthetic
cccaggguggcauaggcagg

SEQ ID NO: 5017 - RNA, 20 nt, Artificial Sequence
  Synthetic
agggggcaggggugcucagg

SEQ ID NO: 5018 - RNA, 20 nt, Artificial Sequence
  Synthetic
uacuggucuccaggccgagg

SEQ ID NO: 5019 - RNA, 20 nt, Artificial Sequence
  Synthetic
auacacaccuggaagggagg

SEQ ID NO: 5020 - RNA, 20 nt, Artificial Sequence
  Synthetic
gacucugccaucccuggagg

SEQ ID NO: 5021 - RNA, 20 nt, Artificial Sequence
  Synthetic
gcucgacgggccccgugagg

SEQ ID NO: 5022 - RNA, 20 nt, Artificial Sequence
  Synthetic
cgacgggccccgugaggcgg

SEQ ID NO: 5023 - RNA, 20 nt, Artificial Sequence
  Synthetic
agcccccuggagaugggcgg

SEQ ID NO: 5024 - RNA, 20 nt, Artificial Sequence
  Synthetic
gcagccgucgcgaccugcgg

SEQ ID NO: 5025 - RNA, 20 nt, Artificial Sequence
  Synthetic
ugaauacacaccuggaaggg

SEQ ID NO: 5026 - RNA, 20 nt, Artificial Sequence
  Synthetic
agaugggcgggggcccaggg

SEQ ID NO: 5027 - RNA, 20 nt, Artificial Sequence
  Synthetic
aggaggggaggaugccaggg

SEQ ID NO: 5028 - RNA, 20 nt, Artificial Sequence
  Synthetic
cuuagguguggggcagaggg

SEQ ID NO: 5029 - RNA, 20 nt, Artificial Sequence
  Synthetic
acaccuggaagggaggaggg

SEQ ID NO: 5030 - RNA, 20 nt, Artificial Sequence
  Synthetic
agcaguuuccauacaucggg

SEQ ID NO: 5031 - RNA, 20 nt, Artificial Sequence
  Synthetic
ccagacauacucaucagggg

SEQ ID NO: 5032 - RNA, 20 nt, Artificial Sequence
  Synthetic
gcagaagugggaaggagggg

SEQ ID NO: 5033 - RNA, 20 nt, Artificial Sequence
  Synthetic
aggguggcauaggcaggggg

SEQ ID NO: 5034 - RNA, 20 nt, Artificial Sequence
  Synthetic
cgggccccgugaggcggggg

SEQ ID NO: 5035 - RNA, 20 nt, Artificial Sequence
  Synthetic
acaaggacagagacaugggg

SEQ ID NO: 5036 - RNA, 20 nt, Artificial Sequence
  Synthetic
ccuccaccuguccucugggg

SEQ ID NO: 5037 - RNA, 20 nt, Artificial Sequence
  Synthetic
cagagcccccuggagauggg

SEQ ID NO: 5038 - RNA, 20 nt, Artificial Sequence
  Synthetic
gaguguggggaagggauggg

SEQ ID NO: 5039 - RNA, 20 nt, Artificial Sequence
  Synthetic
aggcaaggaugcugacuggg

SEQ ID NO: 5040 - RNA, 20 nt, Artificial Sequence
  Synthetic
uccuccaccuguccucuggg

SEQ ID NO: 5041 - RNA, 20 nt, Artificial Sequence
  Synthetic
ccauuccuaggaaagaaugg

SEQ ID NO: 5042 - RNA, 20 nt, Artificial Sequence
  Synthetic
ccugccuuuauggaugaugg

SEQ ID NO: 5043 - RNA, 20 nt, Artificial Sequence
  Synthetic
ugccuuccucaugcugaugg

SEQ ID NO: 5044 - RNA, 20 nt, Artificial Sequence
  Synthetic
aguccuuccaguccaccugg

SEQ ID NO: 5045 - RNA, 20 nt, Artificial Sequence
  Synthetic
agagacucugccaucccugg

SEQ ID NO: 5046 - RNA, 20 nt, Artificial Sequence
  Synthetic
guuguugucccgcaagcugg

SEQ ID NO: 5047 - RNA, 20 nt, Artificial Sequence
  Synthetic
ggaaauuaaagaggagcugg

SEQ ID NO: 5048 - RNA, 20 nt, Artificial Sequence
  Synthetic
uuccuccaccuguccucugg

SEQ ID NO: 5049 - RNA, 20 nt, Artificial Sequence
  Synthetic
cccccccagaggacaggugg

SEQ ID NO: 5050 - RNA, 20 nt, Artificial Sequence
  Synthetic
aggggaggaugccagggugg

SEQ ID NO: 5051 - RNA, 20 nt, Artificial Sequence
  Synthetic
aguuuccauacaucgggugg

SEQ ID NO: 5052 - RNA, 20 nt, Artificial Sequence
  Synthetic
aggacagagacauggggugg

SEQ ID NO: 5053 - RNA, 20 nt, Artificial Sequence
  Synthetic
uguggggaagggaugggugg

SEQ ID NO: 5054 - RNA, 20 nt, Artificial Sequence
  Synthetic
cuccucgguguugucugugg

SEQ ID NO: 5055 - RNA, 20 nt, Artificial Sequence
  Synthetic
gaaacccuggacagacuugg

SEQ ID NO: 5056 - RNA, 20 nt, Artificial Sequence
  Synthetic
cccauuccuaggaaagaaug

SEQ ID NO: 5057 - RNA, 20 nt, Artificial Sequence
  Synthetic
gggacaaggacagagacaug

SEQ ID NO: 5058 - RNA, 20 nt, Artificial Sequence
  Synthetic
ggaaccuucggagcagcaug

SEQ ID NO: 5059 - RNA, 20 nt, Artificial Sequence
  Synthetic
uggagaccuccaucagcaug

SEQ ID NO: 5060 - RNA, 20 nt, Artificial Sequence
  Synthetic
auacucaucagggguggaug

SEQ ID NO: 5061 - RNA, 20 nt, Artificial Sequence
  Synthetic
agagcgucugcucugugaug

SEQ ID NO: 5062 - RNA, 20 nt, Artificial Sequence
  Synthetic
uacccgggccccagucacug

SEQ ID NO: 5063 - RNA, 20 nt, Artificial Sequence
  Synthetic
ccugcuguccacagugacug

SEQ ID NO: 5064 - RNA, 20 nt, Artificial Sequence
  Synthetic
caguccuuccaguccaccug

SEQ ID NO: 5065 - RNA, 20 nt, Artificial Sequence
  Synthetic
cccgcagccgucgcgaccug

SEQ ID NO: 5066 - RNA, 20 nt, Artificial Sequence
  Synthetic
cuuauaguagcaguacccug

SEQ ID NO: 5067 - RNA, 20 nt, Artificial Sequence
  Synthetic
ugggcagccaguggagccug

SEQ ID NO: 5068 - RNA, 20 nt, Artificial Sequence
  Synthetic
cgcaccccuugcagcgccug

SEQ ID NO: 5069 - RNA, 20 nt, Artificial Sequence
  Synthetic
uacagaaagcacaguuccug

SEQ ID NO: 5070 - RNA, 20 nt, Artificial Sequence
  Synthetic
gcugguagcuggucacgcug

SEQ ID NO: 5071 - RNA, 20 nt, Artificial Sequence
  Synthetic
gggcgggccccucggcgcug

SEQ ID NO: 5072 - RNA, 20 nt, Artificial Sequence
  Synthetic
cccgcaggucgcgacggcug

SEQ ID NO: 5073 - RNA, 20 nt, Artificial Sequence
  Synthetic
guuccuccaccuguccucug

SEQ ID NO: 5074 - RNA, 20 nt, Artificial Sequence
  Synthetic
gaaacagcccagguggucug

SEQ ID NO: 5075 - RNA, 20 nt, Artificial Sequence
  Synthetic
cggcuccucgguguugucug

SEQ ID NO: 5076 - RNA, 20 nt, Artificial Sequence
  Synthetic
ucacaguacuccacguucug

SEQ ID NO: 5077 - RNA, 20 nt, Artificial Sequence
  Synthetic
gugacaucccagguagagug

SEQ ID NO: 5078 - RNA, 20 nt, Artificial Sequence
  Synthetic
gagagcaugaucaaggagug

SEQ ID NO: 5079 - RNA, 20 nt, Artificial Sequence
  Synthetic
cgggcucgacgggccccgug

SEQ ID NO: 5080 - RNA, 20 nt, Artificial Sequence
  Synthetic
caaaguacacacagcaggug

SEQ ID NO: 5081 - RNA, 20 nt, Artificial Sequence
  Synthetic
gccacuccauuucuuaggug

SEQ ID NO: 5082 - RNA, 20 nt, Artificial Sequence
  Synthetic
caucagggguggaugcggug

SEQ ID NO: 5083 - RNA, 20 nt, Artificial Sequence
  Synthetic
cucaggcgcugcaaggggug

SEQ ID NO: 5084 - RNA, 20 nt, Artificial Sequence
  Synthetic
aaggacagagacauggggug

SEQ ID NO: 5085 - RNA, 20 nt, Artificial Sequence
  Synthetic
guguggggaagggaugggug

SEQ ID NO: 5086 - RNA, 20 nt, Artificial Sequence
  Synthetic
agaucggcuuccagcuggug

SEQ ID NO: 5087 - RNA, 20 nt, Artificial Sequence
  Synthetic
gacaucccagguagagugug

SEQ ID NO: 5088 - RNA, 20 nt, Artificial Sequence
  Synthetic
cacuccauuucuuaggugug

SEQ ID NO: 5089 - RNA, 20 nt, Artificial Sequence
  Synthetic
augaugguggcuuuaacuug

SEQ ID NO: 5090 - RNA, 20 nt, Artificial Sequence
  Synthetic
ggaaacccuggacagacuug

SEQ ID NO: 5091 - RNA, 20 nt, Artificial Sequence
  Synthetic
guagcguggccuccagcuug

SEQ ID NO: 5092 - RNA, 20 nt, Artificial Sequence
  Synthetic
ccagugcaaccagaacaaau

SEQ ID NO: 5093 - RNA, 20 nt, Artificial Sequence
  Synthetic
acccauuccuaggaaagaau

SEQ ID NO: 5094 - RNA, 20 nt, Artificial Sequence
  Synthetic
gacagagggagacucagaau

SEQ ID NO: 5095 - RNA, 20 nt, Artificial Sequence
  Synthetic
ccccauucuuuccuaggaau

SEQ ID NO: 5096 - RNA, 20 nt, Artificial Sequence
  Synthetic
ugggacaaggacagagacau

SEQ ID NO: 5097 - RNA, 20 nt, Artificial Sequence
  Synthetic
guauagcaguuuccauacau

SEQ ID NO: 5098 - RNA, 20 nt, Artificial Sequence
  Synthetic
gcgggggcccaggguggcau

SEQ ID NO: 5099 - RNA, 20 nt, Artificial Sequence
  Synthetic
cuugguguauguggguucau

SEQ ID NO: 5100 - RNA, 20 nt, Artificial Sequence
  Synthetic
gacuggaaggacuggaagau

SEQ ID NO: 5101 - RNA, 20 nt, Artificial Sequence
  Synthetic
cugcagagcccccuggagau

SEQ ID NO: 5102 - RNA, 20 nt, Artificial Sequence
  Synthetic
aggagagguacauugacgau

SEQ ID NO: 5103 - RNA, 20 nt, Artificial Sequence
  Synthetic
guagaguguggggaagggau

SEQ ID NO: 5104 - RNA, 20 nt, Artificial Sequence
  Synthetic
cucggccuggagaccaguau

SEQ ID NO: 5105 - RNA, 20 nt, Artificial Sequence
  Synthetic
ccugcauggcuuccggcacu

SEQ ID NO: 5106 - RNA, 20 nt, Artificial Sequence
  Synthetic
uaggaaacccuggacagacu

SEQ ID NO: 5107 - RNA, 20 nt, Artificial Sequence
  Synthetic
ggaaggcaaggaugcugacu

SEQ ID NO: 5108 - RNA, 20 nt, Artificial Sequence
  Synthetic
cccugcuguccacagugacu

SEQ ID NO: 5109 - RNA, 20 nt, Artificial Sequence
  Synthetic
gucacccuccuguccaaccu

SEQ ID NO: 5110 - RNA, 20 nt, Artificial Sequence
  Synthetic
gacuucuccucagaccaccu

SEQ ID NO: 5111 - RNA, 20 nt, Artificial Sequence
  Synthetic
ccaguccuuccaguccaccu

SEQ ID NO: 5112 - RNA, 20 nt, Artificial Sequence
  Synthetic
gcagcaucagggacagaccu

SEQ ID NO: 5113 - RNA, 20 nt, Artificial Sequence
  Synthetic
cccuuccccacacucuaccu

SEQ ID NO: 5114 - RNA, 20 nt, Artificial Sequence
  Synthetic
cccccugccuaugccacccu

SEQ ID NO: 5115 - RNA, 20 nt, Artificial Sequence
  Synthetic
ucugcucucucugcaccccu

SEQ ID NO: 5116 - RNA, 20 nt, Artificial Sequence
  Synthetic
ccugagcaccccugcccccu

SEQ ID NO: 5117 - RNA, 20 nt, Artificial Sequence
  Synthetic
ugguuacucacgauggcccu

SEQ ID NO: 5118 - RNA, 20 nt, Artificial Sequence
  Synthetic
gagccugugguucggcuccu

SEQ ID NO: 5119 - RNA, 20 nt, Artificial Sequence
  Synthetic
caucuggaagacccauuccu

SEQ ID NO: 5120 - RNA, 20 nt, Artificial Sequence
  Synthetic
cuacagaaagcacaguuccu

SEQ ID NO: 5121 - RNA, 20 nt, Artificial Sequence
  Synthetic
ugacacccccauucuuuccu

SEQ ID NO: 5122 - RNA, 20 nt, Artificial Sequence
  Synthetic
ucccuggaggaggacacgcu

SEQ ID NO: 5123 - RNA, 20 nt, Artificial Sequence
  Synthetic
agcugguagcuggucacgcu

SEQ ID NO: 5124 - RNA, 20 nt, Artificial Sequence
  Synthetic
agagggagcagggccuggcu

SEQ ID NO: 5125 - RNA, 20 nt, Artificial Sequence
  Synthetic
aguuccuccaccuguccucu

SEQ ID NO: 5126 - RNA, 20 nt, Artificial Sequence
  Synthetic
aggaacaucacugccauucu

SEQ ID NO: 5127 - RNA, 20 nt, Artificial Sequence
  Synthetic
gucacaguacuccacguucu

SEQ ID NO: 5128 - RNA, 20 nt, Artificial Sequence
  Synthetic
cauggggugggggcagaagu

SEQ ID NO: 5129 - RNA, 20 nt, Artificial Sequence
  Synthetic
gggugcagagagagcagagu

SEQ ID NO: 5130 - RNA, 20 nt, Artificial Sequence
  Synthetic
cuuaucaggaaagagagagu

SEQ ID NO: 5131 - RNA, 20 nt, Artificial Sequence
  Synthetic
gcuccacuggcugcccaggu

SEQ ID NO: 5132 - RNA, 20 nt, Artificial Sequence
  Synthetic
uggcugccacggaaucaggu

SEQ ID NO: 5133 - RNA, 20 nt, Artificial Sequence
  Synthetic
cauggaagacauccagaggu

SEQ ID NO: 5134 - RNA, 20 nt, Artificial Sequence
  Synthetic
gagucucccucugucacggu

SEQ ID NO: 5135 - RNA, 20 nt, Artificial Sequence
  Synthetic
uuagguguggggcagagggu

SEQ ID NO: 5136 - RNA, 20 nt, Artificial Sequence
  Synthetic
caaggacagagacauggggu

SEQ ID NO: 5137 - RNA, 20 nt, Artificial Sequence
  Synthetic
aguguggggaagggaugggu

SEQ ID NO: 5138 - RNA, 20 nt, Artificial Sequence
  Synthetic
gggccgcggauagaagaugu

SEQ ID NO: 5139 - RNA, 20 nt, Artificial Sequence
  Synthetic
ucugaucucuugguguaugu

SEQ ID NO: 5140 - RNA, 20 nt, Artificial Sequence
  Synthetic
uuauaguagcaguacccugu

SEQ ID NO: 5141 - RNA, 20 nt, Artificial Sequence
  Synthetic
uggagaaaggugcucagugu

SEQ ID NO: 5142 - RNA, 20 nt, Artificial Sequence
  Synthetic
ugacaucccagguagagugu

SEQ ID NO: 5143 - RNA, 20 nt, Artificial Sequence
  Synthetic
ccacuccauuucuuaggugu

SEQ ID NO: 5144 - RNA, 20 nt, Artificial Sequence
  Synthetic
aggaaacccuggacagacuu

SEQ ID NO: 5145 - RNA, 20 nt, Artificial Sequence
  Synthetic
cuugaagaagauguugacuu

SEQ ID NO: 5146 - RNA, 20 nt, Artificial Sequence
  Synthetic
aguaucggcuucggaaccuu

SEQ ID NO: 5147 - RNA, 20 nt, Artificial Sequence
  Synthetic
cuggagaccaguaucggcuu

SEQ ID NO: 5148 - RNA, 20 nt, Artificial Sequence
  Synthetic
cuuuggccacuccauuucuu

SEQ ID NO: 5149 - RNA, 20 nt, Artificial Sequence
  Synthetic
ggcugccacggaaucagguu

SEQ ID NO: 5150 - RNA, 20 nt, Artificial Sequence
  Synthetic
agccaguggagccugugguu

SEQ ID NO: 5151 - RNA, 18 nt, Artificial Sequence
  Synthetic
gguugauguugaggcuga

SEQ ID NO: 5152 - RNA, 23 nt, Artificial Sequence
  Synthetic
guugagguugauguugaggcuga

SEQ ID NO: 5153 - RNA, 24 nt, Artificial Sequence
  Synthetic
gcccucucccaucaccccuggaac

SEQ ID NO: 5154 - RNA, 21 nt, Artificial Sequence
  Synthetic
gucaaggcugagcucugggcc

SEQ ID NO: 5155 - RNA, 22 nt, Artificial Sequence
  Synthetic
ggucaaggcugagcucugggcc

SEQ ID NO: 5156 - RNA, 23 nt, Artificial Sequence
  Synthetic
gggucaaggcugagcucugggcc

SEQ ID NO: 5157 - RNA, 18 nt, Artificial Sequence
  Synthetic
gaguggauuggggagagc

SEQ ID NO: 5158 - RNA, 19 nt, Artificial Sequence
  Synthetic
ggaguggauuggggagagc

SEQ ID NO: 5159 - RNA, 24 nt, Artificial Sequence
  Synthetic
gccccggaguggauuggggagagc

SEQ ID NO: 5160 - RNA, 24 nt, Artificial Sequence
  Synthetic
gcccuggaguggacuguggagggc

SEQ ID NO: 5161 - RNA, 18 nt, Artificial Sequence
  Synthetic
guaugggcugcagagguc

SEQ ID NO: 5162 - RNA, 19 nt, Artificial Sequence
  Synthetic
gguaugggcugcagagguc

SEQ ID NO: 5163 - RNA, 24 nt, Artificial Sequence
  Synthetic
gaccugguaugggcugcagagguc

SEQ ID NO: 5164 - RNA, 24 nt, Artificial Sequence
  Synthetic
gauaccuccccuuggaagggacag

SEQ ID NO: 5165 - RNA, 18 nt, Artificial Sequence
  Synthetic
gugcugggagcacaccag

SEQ ID NO: 5166 - RNA, 21 nt, Artificial Sequence
  Synthetic
guugugcugggagcacaccag

SEQ ID NO: 5167 - RNA, 22 nt, Artificial Sequence
  Synthetic
gguugugcugggagcacaccag

SEQ ID NO: 5168 - RNA, 24 nt, Artificial Sequence
  Synthetic
gcgguugugcugggagcacaccag

SEQ ID NO: 5169 - RNA, 19 nt, Artificial Sequence
  Synthetic
guacucuccgaaaagcagg

SEQ ID NO: 5170 - RNA, 22 nt, Artificial Sequence
  Synthetic
gaaguacucuccgaaaagcagg

SEQ ID NO: 5171 - RNA, 19 nt, Artificial Sequence
  Synthetic
gauuggggagagcaagggu

SEQ ID NO: 5172 - RNA, 20 nt, Artificial Sequence
  Synthetic
ggauuggggagagcaagggu

SEQ ID NO: 5173 - RNA, 22 nt, Artificial Sequence
  Synthetic
guggauuggggagagcaagggu

SEQ ID NO: 5174 - RNA, 24 nt, Artificial Sequence
  Synthetic
gaguggauuggggagagcaagggu

SEQ ID NO: 5175 - RNA, 19 nt, Artificial Sequence
  Synthetic
gagggacuaaccgaccugu

SEQ ID NO: 5176 - RNA, 22 nt, Artificial Sequence
  Synthetic
gcagagggacuaaccgaccugu

SEQ ID NO: 5177 - RNA, 23 nt, Artificial Sequence
  Synthetic
ggcagagggacuaaccgaccugu

SEQ ID NO: 5178 - RNA, 24 nt, Artificial Sequence
  Synthetic
gggcagagggacuaaccgaccugu

SEQ ID NO: 5179 - RNA, 19 nt, Artificial Sequence
  Synthetic
gcggggaagacgagcuugu

SEQ ID NO: 5180 - RNA, 22 nt, Artificial Sequence
  Synthetic
gacuaaccgaccuguagggauu

SEQ ID NO: 5181 - RNA, 23 nt, Artificial Sequence
  Synthetic
ggacuaaccgaccuguagggauu

SEQ ID NO: 5182 - RNA, 24 nt, Artificial Sequence
  Synthetic
gggacuaaccgaccuguagggauu

SEQ ID NO: 5183 - RNA, 19 nt, Artificial Sequence
  Synthetic
gcggaggaggaggcccuga

SEQ ID NO: 5184 - RNA, 18 nt, Artificial Sequence
  Synthetic
ggccaggggcagccucac

SEQ ID NO: 5185 - RNA, 19 nt, Artificial Sequence
  Synthetic
gcagccucacucggguucc

SEQ ID NO: 5186 - RNA, 21 nt, Artificial Sequence
  Synthetic
ggcaauucggccugcuuuucg

SEQ ID NO: 5187 - RNA, 18 nt, Artificial Sequence
  Synthetic
gcuccuaccgagagcucu

SEQ ID NO: 5188 - RNA, 21 nt, Artificial Sequence
  Synthetic
gguaagcaagggaaccugguu

SEQ ID NO: 5189 - RNA, 19 nt, Artificial Sequence
  Synthetic
agguugauguugaggcuga

SEQ ID NO: 5190 - RNA, 21 nt, Artificial Sequence
  Synthetic
ugagguugauguugaggcuga

SEQ ID NO: 5191 - RNA, 22 nt, Artificial Sequence
  Synthetic
uugagguugauguugaggcuga

SEQ ID NO: 5192 - RNA, 24 nt, Artificial Sequence
  Synthetic
aguugagguugauguugaggcuga

SEQ ID NO: 5193 - RNA, 18 nt, Artificial Sequence
  Synthetic
ucccaucaccccuggaac

SEQ ID NO: 5194 - RNA, 19 nt, Artificial Sequence
  Synthetic
cucccaucaccccuggaac

SEQ ID NO: 5195 - RNA, 20 nt, Artificial Sequence
  Synthetic
ucucccaucaccccuggaac

SEQ ID NO: 5196 - RNA, 21 nt, Artificial Sequence
  Synthetic
cucucccaucaccccuggaac

SEQ ID NO: 5197 - RNA, 22 nt, Artificial Sequence
  Synthetic
ccucucccaucaccccuggaac

SEQ ID NO: 5198 - RNA, 23 nt, Artificial Sequence
  Synthetic
cccucucccaucaccccuggaac

SEQ ID NO: 5199 - RNA, 18 nt, Artificial Sequence
  Synthetic
aaggcugagcucugggcc

SEQ ID NO: 5200 - RNA, 19 nt, Artificial Sequence
  Synthetic
caaggcugagcucugggcc

SEQ ID NO: 5201 - RNA, 20 nt, Artificial Sequence
  Synthetic
ucaaggcugagcucugggcc

SEQ ID NO: 5202 - RNA, 24 nt, Artificial Sequence
  Synthetic
agggucaaggcugagcucugggcc

SEQ ID NO: 5203 - RNA, 20 nt, Artificial Sequence
  Synthetic
cggaguggauuggggagagc

SEQ ID NO: 5204 - RNA, 21 nt, Artificial Sequence
  Synthetic
ccggaguggauuggggagagc

SEQ ID NO: 5205 - RNA, 22 nt, Artificial Sequence
  Synthetic
cccggaguggauuggggagagc

SEQ ID NO: 5206 - RNA, 23 nt, Artificial Sequence
  Synthetic
ccccggaguggauuggggagagc

SEQ ID NO: 5207 - RNA, 21 nt, Artificial Sequence
  Synthetic
cuggaguggacuguggagggc

SEQ ID NO: 5208 - RNA, 22 nt, Artificial Sequence
  Synthetic
ccuggaguggacuguggagggc

SEQ ID NO: 5209 - RNA, 23 nt, Artificial Sequence
  Synthetic
cccuggaguggacuguggagggc

SEQ ID NO: 5210 - RNA, 20 nt, Artificial Sequence
  Synthetic
ugguaugggcugcagagguc

SEQ ID NO: 5211 - RNA, 21 nt, Artificial Sequence
  Synthetic
cugguaugggcugcagagguc

SEQ ID NO: 5212 - RNA, 22 nt, Artificial Sequence
  Synthetic
ccugguaugggcugcagagguc

SEQ ID NO: 5213 - RNA, 23 nt, Artificial Sequence
  Synthetic
accugguaugggcugcagagguc

SEQ ID NO: 5214 - RNA, 18 nt, Artificial Sequence
  Synthetic
uccccuuggaagggacag

SEQ ID NO: 5215 - RNA, 19 nt, Artificial Sequence
  Synthetic
cuccccuuggaagggacag

SEQ ID NO: 5216 - RNA, 20 nt, Artificial Sequence
  Synthetic
ccuccccuuggaagggacag

SEQ ID NO: 5217 - RNA, 21 nt, Artificial Sequence
  Synthetic
accuccccuuggaagggacag

SEQ ID NO: 5218 - RNA, 22 nt, Artificial Sequence
  Synthetic
uaccuccccuuggaagggacag

SEQ ID NO: 5219 - RNA, 23 nt, Artificial Sequence
  Synthetic
auaccuccccuuggaagggacag

SEQ ID NO: 5220 - RNA, 19 nt, Artificial Sequence
  Synthetic
ugugcugggagcacaccag

SEQ ID NO: 5221 - RNA, 23 nt, Artificial Sequence
  Synthetic
cgguugugcugggagcacaccag

SEQ ID NO: 5222 - RNA, 18 nt, Artificial Sequence
  Synthetic
uacucuccgaaaagcagg

SEQ ID NO: 5223 - RNA, 21 nt, Artificial Sequence
  Synthetic
aaguacucuccgaaaagcagg

SEQ ID NO: 5224 - RNA, 23 nt, Artificial Sequence
  Synthetic
ugaaguacucuccgaaaagcagg

SEQ ID NO: 5225 - RNA, 24 nt, Artificial Sequence
  Synthetic
cugaaguacucuccgaaaagcagg

SEQ ID NO: 5226 - RNA, 18 nt, Artificial Sequence
  Synthetic
auuggggagagcaagggu

SEQ ID NO: 5227 - RNA, 21 nt, Artificial Sequence
  Synthetic
uggauuggggagagcaagggu

SEQ ID NO: 5228 - RNA, 23 nt, Artificial Sequence
  Synthetic
aguggauuggggagagcaagggu

SEQ ID NO: 5229 - RNA, 18 nt, Artificial Sequence
  Synthetic
agggacuaaccgaccugu

SEQ ID NO: 5230 - RNA, 21 nt, Artificial Sequence
  Synthetic
cagagggacuaaccgaccugu

SEQ ID NO: 5231 - RNA, 18 nt, Artificial Sequence
  Synthetic
cggggaagacgagcuugu

SEQ ID NO: 5232 - RNA, 21 nt, Artificial Sequence
  Synthetic
cugcggggaagacgagcuugu

SEQ ID NO: 5233 - RNA, 22 nt, Artificial Sequence
  Synthetic
acugcggggaagacgagcuugu

SEQ ID NO: 5234 - RNA, 23 nt, Artificial Sequence
  Synthetic
cacugcggggaagacgagcuugu

SEQ ID NO: 5235 - RNA, 24 nt, Artificial Sequence
  Synthetic
ucacugcggggaagacgagcuugu

SEQ ID NO: 5236 - RNA, 18 nt, Artificial Sequence
  Synthetic
aaccgaccuguagggauu

SEQ ID NO: 5237 - RNA, 19 nt, Artificial Sequence
  Synthetic
uaaccgaccuguagggauu

SEQ ID NO: 5238 - RNA, 20 nt, Artificial Sequence
  Synthetic
cuaaccgaccuguagggauu

SEQ ID NO: 5239 - RNA, 21 nt, Artificial Sequence
  Synthetic
acuaaccgaccuguagggauu

SEQ ID NO: 5240 - RNA, 18 nt, Artificial Sequence
  Synthetic
cggaggaggaggcccuga

SEQ ID NO: 5241 - RNA, 19 nt, Artificial Sequence
  Synthetic
uggccaggggcagccucac

SEQ ID NO: 5242 - RNA, 20 nt, Artificial Sequence
  Synthetic
auggccaggggcagccucac

SEQ ID NO: 5243 - RNA, 18 nt, Artificial Sequence
  Synthetic
cagccucacucggguucc

SEQ ID NO: 5244 - RNA, 18 nt, Artificial Sequence
  Synthetic
aauucggccugcuuuucg

SEQ ID NO: 5245 - RNA, 19 nt, Artificial Sequence
  Synthetic
caauucggccugcuuuucg

SEQ ID NO: 5246 - RNA, 22 nt, Artificial Sequence
  Synthetic
uggcaauucggccugcuuuucg

SEQ ID NO: 5247 - RNA, 23 nt, Artificial Sequence
  Synthetic
cuggcaauucggccugcuuuucg

SEQ ID NO: 5248 - RNA, 24 nt, Artificial Sequence
  Synthetic
acuggcaauucggccugcuuuucg

SEQ ID NO: 5249 - RNA, 19 nt, Artificial Sequence
  Synthetic
cgcuccuaccgagagcucu

SEQ ID NO: 5250 - RNA, 21 nt, Artificial Sequence
  Synthetic
accgcuccuaccgagagcucu

SEQ ID NO: 5251 - RNA, 22 nt, Artificial Sequence
  Synthetic
caccgcuccuaccgagagcucu

SEQ ID NO: 5252 - RNA, 23 nt, Artificial Sequence
  Synthetic
ccaccgcuccuaccgagagcucu

SEQ ID NO: 5253 - RNA, 24 nt, Artificial Sequence
  Synthetic
uccaccgcuccuaccgagagcucu

SEQ ID NO: 5254 - RNA, 18 nt, Artificial Sequence
  Synthetic
aagcaagggaaccugguu

SEQ ID NO: 5255 - RNA, 19 nt, Artificial Sequence
  Synthetic
uaagcaagggaaccugguu

SEQ ID NO: 5256 - RNA, 22 nt, Artificial Sequence
  Synthetic
agguaagcaagggaaccugguu

SEQ ID NO: 5257 - RNA, 23 nt, Artificial Sequence
  Synthetic
aagguaagcaagggaaccugguu

SEQ ID NO: 5258 - RNA, 24 nt, Artificial Sequence
  Synthetic
caagguaagcaagggaaccugguu

SEQ ID NO: 5259 - RNA, 18 nt, Artificial Sequence
  Synthetic
cccuucaugagccccgga

SEQ ID NO: 5260 - RNA, 19 nt, Artificial Sequence
  Synthetic
ccccuucaugagccccgga

SEQ ID NO: 5261 - RNA, 20 nt, Artificial Sequence
  Synthetic
uccccuucaugagccccgga

SEQ ID NO: 5262 - RNA, 21 nt, Artificial Sequence
  Synthetic
uuccccuucaugagccccgga

SEQ ID NO: 5263 - RNA, 22 nt, Artificial Sequence
  Synthetic
guuccccuucaugagccccgga

SEQ ID NO: 5264 - RNA, 23 nt, Artificial Sequence
  Synthetic
uguuccccuucaugagccccgga

SEQ ID NO: 5265 - RNA, 24 nt, Artificial Sequence
  Synthetic
uuguuccccuucaugagccccgga

SEQ ID NO: 5266 - RNA, 18 nt, Artificial Sequence
  Synthetic
guuccccuucaugagccc

SEQ ID NO: 5267 - RNA, 19 nt, Artificial Sequence
  Synthetic
uguuccccuucaugagccc

SEQ ID NO: 5268 - RNA, 21 nt, Artificial Sequence
  Synthetic
cuuguuccccuucaugagccc

SEQ ID NO: 5269 - RNA, 22 nt, Artificial Sequence
  Synthetic
gcuuguuccccuucaugagccc

SEQ ID NO: 5270 - RNA, 23 nt, Artificial Sequence
  Synthetic
agcuuguuccccuucaugagccc

SEQ ID NO: 5271 - RNA, 24 nt, Artificial Sequence
  Synthetic
cagcuuguuccccuucaugagccc

SEQ ID NO: 5272 - RNA, 23 nt, Artificial Sequence
  Synthetic
cgcuuguuccccuucaugagccc

SEQ ID NO: 5273 - RNA, 24 nt, Artificial Sequence
  Synthetic
acgcuuguuccccuucaugagccc

SEQ ID NO: 5274 - RNA, 18 nt, Artificial Sequence
  Synthetic
caccaggcggauggcgcc

SEQ ID NO: 5275 - RNA, 19 nt, Artificial Sequence
  Synthetic
acaccaggcggauggcgcc

SEQ ID NO: 5276 - RNA, 21 nt, Artificial Sequence
  Synthetic
gcacaccaggcggauggcgcc

SEQ ID NO: 5277 - RNA, 22 nt, Artificial Sequence
  Synthetic
agcacaccaggcggauggcgcc

SEQ ID NO: 5278 - RNA, 23 nt, Artificial Sequence
  Synthetic
gagcacaccaggcggauggcgcc

SEQ ID NO: 5279 - RNA, 24 nt, Artificial Sequence
  Synthetic
ggagcacaccaggcggauggcgcc

SEQ ID NO: 5280 - RNA, 18 nt, Artificial Sequence
  Synthetic
gaguggacuguggagggc

SEQ ID NO: 5281 - RNA, 19 nt, Artificial Sequence
  Synthetic
ggaguggacuguggagggc

SEQ ID NO: 5282 - RNA, 21 nt, Artificial Sequence
  Synthetic
cggcggaggaggaggcccuga

SEQ ID NO: 5283 - RNA, 22 nt, Artificial Sequence
  Synthetic
acggcggaggaggaggcccuga

SEQ ID NO: 5284 - RNA, 23 nt, Artificial Sequence
  Synthetic
cacggcggaggaggaggcccuga

SEQ ID NO: 5285 - RNA, 24 nt, Artificial Sequence
  Synthetic
ccacggcggaggaggaggcccuga

SEQ ID NO: 5286 - RNA, 21 nt, Artificial Sequence
  Synthetic
cauggccaggggcagccucac

SEQ ID NO: 5287 - RNA, 22 nt, Artificial Sequence
  Synthetic
gcauggccaggggcagccucac

SEQ ID NO: 5288 - RNA, 23 nt, Artificial Sequence
  Synthetic
ggcauggccaggggcagccucac

SEQ ID NO: 5289 - RNA, 24 nt, Artificial Sequence
  Synthetic
gggcauggccaggggcagccucac

SEQ ID NO: 5290 - RNA, 21 nt, Artificial Sequence
  Synthetic
gggcagccucacucggguucc

SEQ ID NO: 5291 - RNA, 22 nt, Artificial Sequence
  Synthetic
ggggcagccucacucggguucc

SEQ ID NO: 5292 - RNA, 23 nt, Artificial Sequence
  Synthetic
aggggcagccucacucggguucc

SEQ ID NO: 5293 - RNA, 24 nt, Artificial Sequence
  Synthetic
caggggcagccucacucggguucc

SEQ ID NO: 5294 - RNA, 18 nt, Artificial Sequence
  Synthetic
aucaccccuggaacccga

SEQ ID NO: 5295 - RNA, 19 nt, Artificial Sequence
  Synthetic
caucaccccuggaacccga

SEQ ID NO: 5296 - RNA, 20 nt, Artificial Sequence
  Synthetic
ccaucaccccuggaacccga

SEQ ID NO: 5297 - RNA, 21 nt, Artificial Sequence
  Synthetic
cccaucaccccuggaacccga

SEQ ID NO: 5298 - RNA, 22 nt, Artificial Sequence
  Synthetic
ucccaucaccccuggaacccga

SEQ ID NO: 5299 - RNA, 23 nt, Artificial Sequence
  Synthetic
cucccaucaccccuggaacccga

SEQ ID NO: 5300 - RNA, 24 nt, Artificial Sequence
  Synthetic
ucucccaucaccccuggaacccga

SEQ ID NO: 5301 - RNA, 18 nt, Artificial Sequence
  Synthetic
cuaaccgaccuguaggga

SEQ ID NO: 5302 - RNA, 19 nt, Artificial Sequence
  Synthetic
acuaaccgaccuguaggga

SEQ ID NO: 5303 - RNA, 20 nt, Artificial Sequence
  Synthetic
gacuaaccgaccuguaggga

SEQ ID NO: 5304 - RNA, 21 nt, Artificial Sequence
  Synthetic
ggacuaaccgaccuguaggga

SEQ ID NO: 5305 - RNA, 22 nt, Artificial Sequence
  Synthetic
gggacuaaccgaccuguaggga

SEQ ID NO: 5306 - RNA, 23 nt, Artificial Sequence
  Synthetic
agggacuaaccgaccuguaggga

SEQ ID NO: 5307 - RNA, 24 nt, Artificial Sequence
  Synthetic
gagggacuaaccgaccuguaggga

SEQ ID NO: 5308 - RNA, 18 nt, Artificial Sequence
  Synthetic
cccuucaugagcccugga

SEQ ID NO: 5309 - RNA, 19 nt, Artificial Sequence
  Synthetic
ccccuucaugagcccugga

SEQ ID NO: 5310 - RNA, 21 nt, Artificial Sequence
  Synthetic
uuccccuucaugagcccugga

SEQ ID NO: 5311 - RNA, 22 nt, Artificial Sequence
  Synthetic
guuccccuucaugagcccugga

SEQ ID NO: 5312 - RNA, 23 nt, Artificial Sequence
  Synthetic
uguuccccuucaugagcccugga

SEQ ID NO: 5313 - RNA, 24 nt, Artificial Sequence
  Synthetic
uuguuccccuucaugagcccugga

SEQ ID NO: 5314 - RNA, 18 nt, Artificial Sequence
  Synthetic
caugagccccggagugga

SEQ ID NO: 5315 - RNA, 19 nt, Artificial Sequence
  Synthetic
ucaugagccccggagugga

SEQ ID NO: 5316 - RNA, 20 nt, Artificial Sequence
  Synthetic
uucaugagccccggagugga

SEQ ID NO: 5317 - RNA, 21 nt, Artificial Sequence
  Synthetic
cuucaugagccccggagugga

SEQ ID NO: 5318 - RNA, 22 nt, Artificial Sequence
  Synthetic
ccuucaugagccccggagugga

SEQ ID NO: 5319 - RNA, 23 nt, Artificial Sequence
  Synthetic
cccuucaugagccccggagugga

SEQ ID NO: 5320 - RNA, 24 nt, Artificial Sequence
  Synthetic
ccccuucaugagccccggagugga

SEQ ID NO: 5321 - RNA, 18 nt, Artificial Sequence
  Synthetic
augauaccuccccuugga

SEQ ID NO: 5322 - RNA, 19 nt, Artificial Sequence
  Synthetic
caugauaccuccccuugga

SEQ ID NO: 5323 - RNA, 21 nt, Artificial Sequence
  Synthetic
cucaugauaccuccccuugga

SEQ ID NO: 5324 - RNA, 22 nt, Artificial Sequence
  Synthetic
gcucaugauaccuccccuugga

SEQ ID NO: 5325 - RNA, 23 nt, Artificial Sequence
  Synthetic
ugcucaugauaccuccccuugga

SEQ ID NO: 5326 - RNA, 24 nt, Artificial Sequence
  Synthetic
cugcucaugauaccuccccuugga

SEQ ID NO: 5327 - RNA, 18 nt, Artificial Sequence
  Synthetic
guguuguugcagaagaac

SEQ ID NO: 5328 - RNA, 19 nt, Artificial Sequence
  Synthetic
gguguuguugcagaagaac

SEQ ID NO: 5329 - RNA, 21 nt, Artificial Sequence
  Synthetic
gugguguuguugcagaagaac

SEQ ID NO: 5330 - RNA, 22 nt, Artificial Sequence
  Synthetic
ggugguguuguugcagaagaac

SEQ ID NO: 5331 - RNA, 23 nt, Artificial Sequence
  Synthetic
uggugguguuguugcagaagaac

SEQ ID NO: 5332 - RNA, 24 nt, Artificial Sequence
  Synthetic
auggugguguuguugcagaagaac

SEQ ID NO: 5333 - RNA, 18 nt, Artificial Sequence
  Synthetic
ugcccucucccaucaccc

SEQ ID NO: 5334 - RNA, 19 nt, Artificial Sequence
  Synthetic
gugcccucucccaucaccc

SEQ ID NO: 5335 - RNA, 20 nt, Artificial Sequence
  Synthetic
agugcccucucccaucaccc

SEQ ID NO: 5336 - RNA, 21 nt, Artificial Sequence
  Synthetic
gagugcccucucccaucaccc

SEQ ID NO: 5337 - RNA, 22 nt, Artificial Sequence
  Synthetic
ugagugcccucucccaucaccc

SEQ ID NO: 5338 - RNA, 23 nt, Artificial Sequence
  Synthetic
cugagugcccucucccaucaccc

SEQ ID NO: 5339 - RNA, 24 nt, Artificial Sequence
  Synthetic
ccugagugcccucucccaucaccc

SEQ ID NO: 5340 - RNA, 18 nt, Artificial Sequence
  Synthetic
gcccucucccaucacccc

SEQ ID NO: 5341 - RNA, 19 nt, Artificial Sequence
  Synthetic
ugcccucucccaucacccc

SEQ ID NO: 5342 - RNA, 21 nt, Artificial Sequence
  Synthetic
agugcccucucccaucacccc

SEQ ID NO: 5343 - RNA, 22 nt, Artificial Sequence
  Synthetic
gagugcccucucccaucacccc

SEQ ID NO: 5344 - RNA, 23 nt, Artificial Sequence
  Synthetic
ugagugcccucucccaucacccc

SEQ ID NO: 5345 - RNA, 24 nt, Artificial Sequence
  Synthetic
cugagugcccucucccaucacccc

SEQ ID NO: 5346 - RNA, 18 nt, Artificial Sequence
  Synthetic
ugcucaugauaccucccc

SEQ ID NO: 5347 - RNA, 19 nt, Artificial Sequence
  Synthetic
cugcucaugauaccucccc

SEQ ID NO: 5348 - RNA, 20 nt, Artificial Sequence
  Synthetic
acugcucaugauaccucccc

SEQ ID NO: 5349 - RNA, 21 nt, Artificial Sequence
  Synthetic
uacugcucaugauaccucccc

SEQ ID NO: 5350 - RNA, 22 nt, Artificial Sequence
  Synthetic
auacugcucaugauaccucccc

SEQ ID NO: 5351 - RNA, 23 nt, Artificial Sequence
  Synthetic
gauacugcucaugauaccucccc

SEQ ID NO: 5352 - RNA, 24 nt, Artificial Sequence
  Synthetic
ugauacugcucaugauaccucccc

SEQ ID NO: 5353 - RNA, 18 nt, Artificial Sequence
  Synthetic
uguuccccuucaugagcc

SEQ ID NO: 5354 - RNA, 19 nt, Artificial Sequence
  Synthetic
uuguuccccuucaugagcc

SEQ ID NO: 5355 - RNA, 21 nt, Artificial Sequence
  Synthetic
gcuuguuccccuucaugagcc

SEQ ID NO: 5356 - RNA, 22 nt, Artificial Sequence
  Synthetic
agcuuguuccccuucaugagcc

SEQ ID NO: 5357 - RNA, 23 nt, Artificial Sequence
  Synthetic
cagcuuguuccccuucaugagcc

SEQ ID NO: 5358 - RNA, 24 nt, Artificial Sequence
  Synthetic
ccagcuuguuccccuucaugagcc

SEQ ID NO: 5359 - RNA, 22 nt, Artificial Sequence
  Synthetic
cgcuuguuccccuucaugagcc

SEQ ID NO: 5360 - RNA, 23 nt, Artificial Sequence
  Synthetic
acgcuuguuccccuucaugagcc

SEQ ID NO: 5361 - RNA, 24 nt, Artificial Sequence
  Synthetic
cacgcuuguuccccuucaugagcc

SEQ ID NO: 5362 - RNA, 18 nt, Artificial Sequence
  Synthetic
agggccuccuccuccgcc

SEQ ID NO: 5363 - RNA, 19 nt, Artificial Sequence
  Synthetic
cagggccuccuccuccgcc

SEQ ID NO: 5364 - RNA, 21 nt, Artificial Sequence
  Synthetic
aucagggccuccuccuccgcc

SEQ ID NO: 5365 - RNA, 22 nt, Artificial Sequence
  Synthetic
gaucagggccuccuccuccgcc

SEQ ID NO: 5366 - RNA, 23 nt, Artificial Sequence
  Synthetic
cgaucagggccuccuccuccgcc

SEQ ID NO: 5367 - RNA, 24 nt, Artificial Sequence
  Synthetic
ucgaucagggccuccuccuccgcc

SEQ ID NO: 5368 - RNA, 18 nt, Artificial Sequence
  Synthetic
cagagccacagcacugcc

SEQ ID NO: 5369 - RNA, 19 nt, Artificial Sequence
  Synthetic
gcagagccacagcacugcc

SEQ ID NO: 5370 - RNA, 21 nt, Artificial Sequence
  Synthetic
gugcagagccacagcacugcc

SEQ ID NO: 5371 - RNA, 22 nt, Artificial Sequence
  Synthetic
ggugcagagccacagcacugcc

SEQ ID NO: 5372 - RNA, 23 nt, Artificial Sequence
  Synthetic
aggugcagagccacagcacugcc

SEQ ID NO: 5373 - RNA, 24 nt, Artificial Sequence
  Synthetic
aaggugcagagccacagcacugcc

SEQ ID NO: 5374 - RNA, 18 nt, Artificial Sequence
  Synthetic
uccagcuuguuccccucc

SEQ ID NO: 5375 - RNA, 19 nt, Artificial Sequence
  Synthetic
cuccagcuuguuccccucc

SEQ ID NO: 5376 - RNA, 21 nt, Artificial Sequence
  Synthetic
uccuccagcuuguuccccucc

SEQ ID NO: 5377 - RNA, 22 nt, Artificial Sequence
  Synthetic
cuccuccagcuuguuccccucc

SEQ ID NO: 5378 - RNA, 23 nt, Artificial Sequence
  Synthetic
gcuccuccagcuuguuccccucc

SEQ ID NO: 5379 - RNA, 24 nt, Artificial Sequence
  Synthetic
ugcuccuccagcuuguuccccucc

SEQ ID NO: 5380 - RNA, 18 nt, Artificial Sequence
  Synthetic
ggugcagauggucacugc

SEQ ID NO: 5381 - RNA, 19 nt, Artificial Sequence
  Synthetic
gggugcagauggucacugc

SEQ ID NO: 5382 - RNA, 21 nt, Artificial Sequence
  Synthetic
gagggugcagauggucacugc

SEQ ID NO: 5383 - RNA, 22 nt, Artificial Sequence
  Synthetic
ugagggugcagauggucacugc

SEQ ID NO: 5384 - RNA, 23 nt, Artificial Sequence
  Synthetic
uugagggugcagauggucacugc

SEQ ID NO: 5385 - RNA, 24 nt, Artificial Sequence
  Synthetic
auugagggugcagauggucacugc

SEQ ID NO: 5386 - RNA, 18 nt, Artificial Sequence
  Synthetic
uccuccgccgugggcugc

SEQ ID NO: 5387 - RNA, 19 nt, Artificial Sequence
  Synthetic
cuccuccgccgugggcugc

SEQ ID NO: 5388 - RNA, 21 nt, Artificial Sequence
  Synthetic
uccuccuccgccgugggcugc

SEQ ID NO: 5389 - RNA, 22 nt, Artificial Sequence
  Synthetic
cuccuccuccgccgugggcugc

SEQ ID NO: 5390 - RNA, 23 nt, Artificial Sequence
  Synthetic
ccuccuccuccgccgugggcugc

SEQ ID NO: 5391 - RNA, 24 nt, Artificial Sequence
  Synthetic
gccuccuccuccgccgugggcugc

SEQ ID NO: 5392 - RNA, 18 nt, Artificial Sequence
  Synthetic
gucuucaugcgguugugc

SEQ ID NO: 5393 - RNA, 19 nt, Artificial Sequence
  Synthetic
cgucuucaugcgguugugc

SEQ ID NO: 5394 - RNA, 21 nt, Artificial Sequence
  Synthetic
gccgucuucaugcgguugugc

SEQ ID NO: 5395 - RNA, 22 nt, Artificial Sequence
  Synthetic
ggccgucuucaugcgguugugc

SEQ ID NO: 5396 - RNA, 23 nt, Artificial Sequence
  Synthetic
aggccgucuucaugcgguugugc

SEQ ID NO: 5397 - RNA, 24 nt, Artificial Sequence
  Synthetic
aaggccgucuucaugcgguugugc

SEQ ID NO: 5398 - RNA, 18 nt, Artificial Sequence
  Synthetic
uccagcuuguuccccuuc

SEQ ID NO: 5399 - RNA, 19 nt, Artificial Sequence
  Synthetic
cuccagcuuguuccccuuc

SEQ ID NO: 5400 - RNA, 20 nt, Artificial Sequence
  Synthetic
ccuccagcuuguuccccuuc

SEQ ID NO: 5401 - RNA, 21 nt, Artificial Sequence
  Synthetic
uccuccagcuuguuccccuuc

SEQ ID NO: 5402 - RNA, 22 nt, Artificial Sequence
  Synthetic
cuccuccagcuuguuccccuuc

SEQ ID NO: 5403 - RNA, 23 nt, Artificial Sequence
  Synthetic
gcuccuccagcuuguuccccuuc

SEQ ID NO: 5404 - RNA, 24 nt, Artificial Sequence
  Synthetic
ugcuccuccagcuuguuccccuuc

SEQ ID NO: 5405 - RNA, 18 nt, Artificial Sequence
  Synthetic
ucacgcuuguuccccuuc

SEQ ID NO: 5406 - RNA, 19 nt, Artificial Sequence
  Synthetic
cucacgcuuguuccccuuc

SEQ ID NO: 5407 - RNA, 21 nt, Artificial Sequence
  Synthetic
uccucacgcuuguuccccuuc

SEQ ID NO: 5408 - RNA, 22 nt, Artificial Sequence
  Synthetic
cuccucacgcuuguuccccuuc

SEQ ID NO: 5409 - RNA, 23 nt, Artificial Sequence
  Synthetic
gcuccucacgcuuguuccccuuc

SEQ ID NO: 5410 - RNA, 24 nt, Artificial Sequence
  Synthetic
ugcuccucacgcuuguuccccuuc

SEQ ID NO: 5411 - RNA, 18 nt, Artificial Sequence
  Synthetic
auggucacugcggggaag

SEQ ID NO: 5412 - RNA, 19 nt, Artificial Sequence
  Synthetic
gauggucacugcggggaag

SEQ ID NO: 5413 - RNA, 21 nt, Artificial Sequence
  Synthetic
cagauggucacugcggggaag

SEQ ID NO: 5414 - RNA, 22 nt, Artificial Sequence
  Synthetic
gcagauggucacugcggggaag

SEQ ID NO: 5415 - RNA, 23 nt, Artificial Sequence
  Synthetic
ugcagauggucacugcggggaag

SEQ ID NO: 5416 - RNA, 24 nt, Artificial Sequence
  Synthetic
gugcagauggucacugcggggaag

SEQ ID NO: 5417 - RNA, 18 nt, Artificial Sequence
  Synthetic
auggugguguuguugcag

SEQ ID NO: 5418 - RNA, 19 nt, Artificial Sequence
  Synthetic
gauggugguguuguugcag

SEQ ID NO: 5419 - RNA, 21 nt, Artificial Sequence
  Synthetic
uggauggugguguuguugcag

SEQ ID NO: 5420 - RNA, 22 nt, Artificial Sequence
  Synthetic
guggauggugguguuguugcag

SEQ ID NO: 5421 - RNA, 23 nt, Artificial Sequence
  Synthetic
cguggauggugguguuguugcag

SEQ ID NO: 5422 - RNA, 24 nt, Artificial Sequence
  Synthetic
ccguggauggugguguuguugcag

SEQ ID NO: 5423 - RNA, 18 nt, Artificial Sequence
  Synthetic
aagacgagcuuguccgag

SEQ ID NO: 5424 - RNA, 19 nt, Artificial Sequence
  Synthetic
gaagacgagcuuguccgag

SEQ ID NO: 5425 - RNA, 21 nt, Artificial Sequence
  Synthetic
gggaagacgagcuuguccgag

SEQ ID NO: 5426 - RNA, 22 nt, Artificial Sequence
  Synthetic
ggggaagacgagcuuguccgag

SEQ ID NO: 5427 - RNA, 23 nt, Artificial Sequence
  Synthetic
cggggaagacgagcuuguccgag

SEQ ID NO: 5428 - RNA, 24 nt, Artificial Sequence
  Synthetic
gcggggaagacgagcuuguccgag

SEQ ID NO: 5429 - RNA, 18 nt, Artificial Sequence
  Synthetic
uugaggcugacgggguag

SEQ ID NO: 5430 - RNA, 19 nt, Artificial Sequence
  Synthetic
guugaggcugacgggguag

SEQ ID NO: 5431 - RNA, 21 nt, Artificial Sequence
  Synthetic
auguugaggcugacgggguag

SEQ ID NO: 5432 - RNA, 22 nt, Artificial Sequence
  Synthetic
gauguugaggcugacgggguag

SEQ ID NO: 5433 - RNA, 23 nt, Artificial Sequence
  Synthetic
ugauguugaggcugacgggguag

SEQ ID NO: 5434 - RNA, 24 nt, Artificial Sequence
  Synthetic
uugauguugaggcugacgggguag

SEQ ID NO: 5435 - RNA, 18 nt, Artificial Sequence
  Synthetic
gagcucucgguaggagcg

SEQ ID NO: 5436 - RNA, 19 nt, Artificial Sequence
  Synthetic
agagcucucgguaggagcg

SEQ ID NO: 5437 - RNA, 21 nt, Artificial Sequence
  Synthetic
gaagagcucucgguaggagcg

SEQ ID NO: 5438 - RNA, 22 nt, Artificial Sequence
  Synthetic
cgaagagcucucgguaggagcg

SEQ ID NO: 5439 - RNA, 23 nt, Artificial Sequence
  Synthetic
ucgaagagcucucgguaggagcg

SEQ ID NO: 5440 - RNA, 24 nt, Artificial Sequence
  Synthetic
cucgaagagcucucgguaggagcg

SEQ ID NO: 5441 - RNA, 18 nt, Artificial Sequence
  Synthetic
gugcagauggucacugcg

SEQ ID NO: 5442 - RNA, 19 nt, Artificial Sequence
  Synthetic
ggugcagauggucacugcg

SEQ ID NO: 5443 - RNA, 21 nt, Artificial Sequence
  Synthetic
agggugcagauggucacugcg

SEQ ID NO: 5444 - RNA, 22 nt, Artificial Sequence
  Synthetic
gagggugcagauggucacugcg

SEQ ID NO: 5445 - RNA, 23 nt, Artificial Sequence
  Synthetic
ugagggugcagauggucacugcg

SEQ ID NO: 5446 - RNA, 24 nt, Artificial Sequence
  Synthetic
uugagggugcagauggucacugcg

SEQ ID NO: 5447 - RNA, 18 nt, Artificial Sequence
  Synthetic
uuguugcagaagaacucg

SEQ ID NO: 5448 - RNA, 19 nt, Artificial Sequence
  Synthetic
guuguugcagaagaacucg

SEQ ID NO: 5449 - RNA, 21 nt, Artificial Sequence
  Synthetic
guguuguugcagaagaacucg

SEQ ID NO: 5450 - RNA, 22 nt, Artificial Sequence
  Synthetic
gguguuguugcagaagaacucg

SEQ ID NO: 5451 - RNA, 23 nt, Artificial Sequence
  Synthetic
ugguguuguugcagaagaacucg

SEQ ID NO: 5452 - RNA, 24 nt, Artificial Sequence
  Synthetic
gugguguuguugcagaagaacucg

SEQ ID NO: 5453 - RNA, 18 nt, Artificial Sequence
  Synthetic
caagggucagggucaagg

SEQ ID NO: 5454 - RNA, 19 nt, Artificial Sequence
  Synthetic
gcaagggucagggucaagg

SEQ ID NO: 5455 - RNA, 20 nt, Artificial Sequence
  Synthetic
agcaagggucagggucaagg

SEQ ID NO: 5456 - RNA, 21 nt, Artificial Sequence
  Synthetic
gagcaagggucagggucaagg

SEQ ID NO: 5457 - RNA, 22 nt, Artificial Sequence
  Synthetic
agagcaagggucagggucaagg

SEQ ID NO: 5458 - RNA, 23 nt, Artificial Sequence
  Synthetic
gagagcaagggucagggucaagg

SEQ ID NO: 5459 - RNA, 24 nt, Artificial Sequence
  Synthetic
ggagagcaagggucagggucaagg

SEQ ID NO: 5460 - RNA, 18 nt, Artificial Sequence
  Synthetic
agcucucgguaggagcgg

SEQ ID NO: 5461 - RNA, 19 nt, Artificial Sequence
  Synthetic
gagcucucgguaggagcgg

SEQ ID NO: 5462 - RNA, 21 nt, Artificial Sequence
  Synthetic
aagagcucucgguaggagcgg

SEQ ID NO: 5463 - RNA, 22 nt, Artificial Sequence
  Synthetic
gaagagcucucgguaggagcgg

SEQ ID NO: 5464 - RNA, 23 nt, Artificial Sequence
  Synthetic
cgaagagcucucgguaggagcgg

SEQ ID NO: 5465 - RNA, 24 nt, Artificial Sequence
  Synthetic
ucgaagagcucucgguaggagcgg

SEQ ID NO: 5466 - RNA, 18 nt, Artificial Sequence
  Synthetic
aacucgaagagcucucgg

SEQ ID NO: 5467 - RNA, 19 nt, Artificial Sequence
  Synthetic
gaacucgaagagcucucgg

SEQ ID NO: 5468 - RNA, 21 nt, Artificial Sequence
  Synthetic
aagaacucgaagagcucucgg

SEQ ID NO: 5469 - RNA, 22 nt, Artificial Sequence
  Synthetic
gaagaacucgaagagcucucgg

SEQ ID NO: 5470 - RNA, 23 nt, Artificial Sequence
  Synthetic
agaagaacucgaagagcucucgg

SEQ ID NO: 5471 - RNA, 24 nt, Artificial Sequence
  Synthetic
cagaagaacucgaagagcucucgg

SEQ ID NO: 5472 - RNA, 18 nt, Artificial Sequence
  Synthetic
gccccggaguggauuggg

SEQ ID NO: 5473 - RNA, 19 nt, Artificial Sequence
  Synthetic
agccccggaguggauuggg

SEQ ID NO: 5474 - RNA, 20 nt, Artificial Sequence
  Synthetic
gagccccggaguggauuggg

SEQ ID NO: 5475 - RNA, 21 nt, Artificial Sequence
  Synthetic
ugagccccggaguggauuggg

SEQ ID NO: 5476 - RNA, 22 nt, Artificial Sequence
  Synthetic
augagccccggaguggauuggg

SEQ ID NO: 5477 - RNA, 23 nt, Artificial Sequence
  Synthetic
caugagccccggaguggauuggg

SEQ ID NO: 5478 - RNA, 24 nt, Artificial Sequence
  Synthetic
ucaugagccccggaguggauuggg

SEQ ID NO: 5479 - RNA, 18 nt, Artificial Sequence
  Synthetic
caugauaccuccccuugg

SEQ ID NO: 5480 - RNA, 19 nt, Artificial Sequence
  Synthetic
ucaugauaccuccccuugg

SEQ ID NO: 5481 - RNA, 20 nt, Artificial Sequence
  Synthetic
cucaugauaccuccccuugg

SEQ ID NO: 5482 - RNA, 21 nt, Artificial Sequence
  Synthetic
gcucaugauaccuccccuugg

SEQ ID NO: 5483 - RNA, 22 nt, Artificial Sequence
  Synthetic
ugcucaugauaccuccccuugg

SEQ ID NO: 5484 - RNA, 23 nt, Artificial Sequence
  Synthetic
cugcucaugauaccuccccuugg

SEQ ID NO: 5485 - RNA, 24 nt, Artificial Sequence
  Synthetic
acugcucaugauaccuccccuugg

SEQ ID NO: 5486 - RNA, 18 nt, Artificial Sequence
  Synthetic
uccgaguugagguugaug

SEQ ID NO: 5487 - RNA, 19 nt, Artificial Sequence
  Synthetic
guccgaguugagguugaug

SEQ ID NO: 5488 - RNA, 21 nt, Artificial Sequence
  Synthetic
uuguccgaguugagguugaug

SEQ ID NO: 5489 - RNA, 22 nt, Artificial Sequence
  Synthetic
cuuguccgaguugagguugaug

SEQ ID NO: 5490 - RNA, 23 nt, Artificial Sequence
  Synthetic
gcuuguccgaguugagguugaug

SEQ ID NO: 5491 - RNA, 24 nt, Artificial Sequence
  Synthetic
agcuuguccgaguugagguugaug

SEQ ID NO: 5492 - RNA, 18 nt, Artificial Sequence
  Synthetic
gggugcagauggucacug

SEQ ID NO: 5493 - RNA, 19 nt, Artificial Sequence
  Synthetic
agggugcagauggucacug

SEQ ID NO: 5494 - RNA, 21 nt, Artificial Sequence
  Synthetic
ugagggugcagauggucacug

SEQ ID NO: 5495 - RNA, 22 nt, Artificial Sequence
  Synthetic
uugagggugcagauggucacug

SEQ ID NO: 5496 - RNA, 23 nt, Artificial Sequence
  Synthetic
auugagggugcagauggucacug

SEQ ID NO: 5497 - RNA, 24 nt, Artificial Sequence
  Synthetic
gauugagggugcagauggucacug

SEQ ID NO: 5498 - RNA, 18 nt, Artificial Sequence
  Synthetic
gagcccuggaguggacug

SEQ ID NO: 5499 - RNA, 19 nt, Artificial Sequence
  Synthetic
ugagcccuggaguggacug

SEQ ID NO: 5500 - RNA, 21 nt, Artificial Sequence
  Synthetic
caugagcccuggaguggacug

SEQ ID NO: 5501 - RNA, 22 nt, Artificial Sequence
  Synthetic
ucaugagcccuggaguggacug

SEQ ID NO: 5502 - RNA, 23 nt, Artificial Sequence
  Synthetic
uucaugagcccuggaguggacug

SEQ ID NO: 5503 - RNA, 24 nt, Artificial Sequence
  Synthetic
cuucaugagcccuggaguggacug

SEQ ID NO: 5504 - RNA, 18 nt, Artificial Sequence
  Synthetic
gagggacuaaccgaccug

SEQ ID NO: 5505 - RNA, 19 nt, Artificial Sequence
  Synthetic
agagggacuaaccgaccug

SEQ ID NO: 5506 - RNA, 20 nt, Artificial Sequence
  Synthetic
cagagggacuaaccgaccug

SEQ ID NO: 5507 - RNA, 21 nt, Artificial Sequence
  Synthetic
gcagagggacuaaccgaccug

SEQ ID NO: 5508 - RNA, 22 nt, Artificial Sequence
  Synthetic
ggcagagggacuaaccgaccug

SEQ ID NO: 5509 - RNA, 23 nt, Artificial Sequence
  Synthetic
gggcagagggacuaaccgaccug

SEQ ID NO: 5510 - RNA, 24 nt, Artificial Sequence
  Synthetic
ggggcagagggacuaaccgaccug

SEQ ID NO: 5511 - RNA, 18 nt, Artificial Sequence
  Synthetic
agguugauguugaggcug

SEQ ID NO: 5512 - RNA, 19 nt, Artificial Sequence
  Synthetic
gagguugauguugaggcug

SEQ ID NO: 5513 - RNA, 21 nt, Artificial Sequence
  Synthetic
uugagguugauguugaggcug

SEQ ID NO: 5514 - RNA, 22 nt, Artificial Sequence
  Synthetic
guugagguugauguugaggcug

SEQ ID NO: 5515 - RNA, 23 nt, Artificial Sequence
  Synthetic
aguugagguugauguugaggcug

SEQ ID NO: 5516 - RNA, 24 nt, Artificial Sequence
  Synthetic
gaguugagguugauguugaggcug

SEQ ID NO: 5517 - RNA, 18 nt, Artificial Sequence
  Synthetic
gagaccugguaugggcug

SEQ ID NO: 5518 - RNA, 19 nt, Artificial Sequence
  Synthetic
ugagaccugguaugggcug

SEQ ID NO: 5519 - RNA, 20 nt, Artificial Sequence
  Synthetic
augagaccugguaugggcug

SEQ ID NO: 5520 - RNA, 21 nt, Artificial Sequence
  Synthetic
caugagaccugguaugggcug

SEQ ID NO: 5521 - RNA, 22 nt, Artificial Sequence
  Synthetic
ccaugagaccugguaugggcug

SEQ ID NO: 5522 - RNA, 23 nt, Artificial Sequence
  Synthetic
uccaugagaccugguaugggcug

SEQ ID NO: 5523 - RNA, 24 nt, Artificial Sequence
  Synthetic
cuccaugagaccugguaugggcug

SEQ ID NO: 5524 - RNA, 18 nt, Artificial Sequence
  Synthetic
cuccuccgccgugggcug

SEQ ID NO: 5525 - RNA, 19 nt, Artificial Sequence
  Synthetic
ccuccuccgccgugggcug

SEQ ID NO: 5526 - RNA, 21 nt, Artificial Sequence
  Synthetic
cuccuccuccgccgugggcug

SEQ ID NO: 5527 - RNA, 22 nt, Artificial Sequence
  Synthetic
ccuccuccuccgccgugggcug

SEQ ID NO: 5528 - RNA, 23 nt, Artificial Sequence
  Synthetic
gccuccuccuccgccgugggcug

SEQ ID NO: 5529 - RNA, 24 nt, Artificial Sequence
  Synthetic
ggccuccuccuccgccgugggcug

SEQ ID NO: 5530 - RNA, 18 nt, Artificial Sequence
  Synthetic
uacaucaugccaaaggug

SEQ ID NO: 5531 - RNA, 19 nt, Artificial Sequence
  Synthetic
guacaucaugccaaaggug

SEQ ID NO: 5532 - RNA, 21 nt, Artificial Sequence
  Synthetic
caguacaucaugccaaaggug

SEQ ID NO: 5533 - RNA, 22 nt, Artificial Sequence
  Synthetic
ccaguacaucaugccaaaggug

SEQ ID NO: 5534 - RNA, 23 nt, Artificial Sequence
  Synthetic
gccaguacaucaugccaaaggug

SEQ ID NO: 5535 - RNA, 24 nt, Artificial Sequence
  Synthetic
ugccaguacaucaugccaaaggug

SEQ ID NO: 5536 - RNA, 18 nt, Artificial Sequence
  Synthetic
gcccuggaguggacugug

SEQ ID NO: 5537 - RNA, 19 nt, Artificial Sequence
  Synthetic
agcccuggaguggacugug

SEQ ID NO: 5538 - RNA, 21 nt, Artificial Sequence
  Synthetic
ugagcccuggaguggacugug

SEQ ID NO: 5539 - RNA, 22 nt, Artificial Sequence
  Synthetic
augagcccuggaguggacugug

SEQ ID NO: 5540 - RNA, 23 nt, Artificial Sequence
  Synthetic
caugagcccuggaguggacugug

SEQ ID NO: 5541 - RNA, 24 nt, Artificial Sequence
  Synthetic
ucaugagcccuggaguggacugug

SEQ ID NO: 5542 - RNA, 18 nt, Artificial Sequence
  Synthetic
cgucuucaugcgguugug

SEQ ID NO: 5543 - RNA, 19 nt, Artificial Sequence
  Synthetic
ccgucuucaugcgguugug

SEQ ID NO: 5544 - RNA, 21 nt, Artificial Sequence
  Synthetic
ggccgucuucaugcgguugug

SEQ ID NO: 5545 - RNA, 22 nt, Artificial Sequence
  Synthetic
aggccgucuucaugcgguugug

SEQ ID NO: 5546 - RNA, 23 nt, Artificial Sequence
  Synthetic
aaggccgucuucaugcgguugug

SEQ ID NO: 5547 - RNA, 24 nt, Artificial Sequence
  Synthetic
gaaggccgucuucaugcgguugug

SEQ ID NO: 5548 - RNA, 18 nt, Artificial Sequence
  Synthetic
gagccccggaguggauug

SEQ ID NO: 5549 - RNA, 19 nt, Artificial Sequence
  Synthetic
ugagccccggaguggauug

SEQ ID NO: 5550 - RNA, 21 nt, Artificial Sequence
  Synthetic
caugagccccggaguggauug

SEQ ID NO: 5551 - RNA, 22 nt, Artificial Sequence
  Synthetic
ucaugagccccggaguggauug

SEQ ID NO: 5552 - RNA, 23 nt, Artificial Sequence
  Synthetic
uucaugagccccggaguggauug

SEQ ID NO: 5553 - RNA, 24 nt, Artificial Sequence
  Synthetic
cuucaugagccccggaguggauug

SEQ ID NO: 5554 - RNA, 18 nt, Artificial Sequence
  Synthetic
uggauggugguguuguug

SEQ ID NO: 5555 - RNA, 19 nt, Artificial Sequence
  Synthetic
guggauggugguguuguug

SEQ ID NO: 5556 - RNA, 21 nt, Artificial Sequence
  Synthetic
ccguggauggugguguuguug

SEQ ID NO: 5557 - RNA, 22 nt, Artificial Sequence
  Synthetic
gccguggauggugguguuguug

SEQ ID NO: 5558 - RNA, 23 nt, Artificial Sequence
  Synthetic
cgccguggauggugguguuguug

SEQ ID NO: 5559 - RNA, 24 nt, Artificial Sequence
  Synthetic
gcgccguggauggugguguuguug

SEQ ID NO: 5560 - RNA, 18 nt, Artificial Sequence
  Synthetic
ggagcgguggaacucgau

SEQ ID NO: 5561 - RNA, 19 nt, Artificial Sequence
  Synthetic
aggagcgguggaacucgau

SEQ ID NO: 5562 - RNA, 21 nt, Artificial Sequence
  Synthetic
guaggagcgguggaacucgau

SEQ ID NO: 5563 - RNA, 22 nt, Artificial Sequence
  Synthetic
gguaggagcgguggaacucgau

SEQ ID NO: 5564 - RNA, 23 nt, Artificial Sequence
  Synthetic
cgguaggagcgguggaacucgau

SEQ ID NO: 5565 - RNA, 24 nt, Artificial Sequence
  Synthetic
ucgguaggagcgguggaacucgau

SEQ ID NO: 5566 - RNA, 18 nt, Artificial Sequence
  Synthetic
augagccccggaguggau

SEQ ID NO: 5567 - RNA, 19 nt, Artificial Sequence
  Synthetic
caugagccccggaguggau

SEQ ID NO: 5568 - RNA, 21 nt, Artificial Sequence
  Synthetic
uucaugagccccggaguggau

SEQ ID NO: 5569 - RNA, 22 nt, Artificial Sequence
  Synthetic
cuucaugagccccggaguggau

SEQ ID NO: 5570 - RNA, 23 nt, Artificial Sequence
  Synthetic
ccuucaugagccccggaguggau

SEQ ID NO: 5571 - RNA, 24 nt, Artificial Sequence
  Synthetic
cccuucaugagccccggaguggau

SEQ ID NO: 5572 - RNA, 18 nt, Artificial Sequence
  Synthetic
agggugcagauggucacu

SEQ ID NO: 5573 - RNA, 19 nt, Artificial Sequence
  Synthetic
gagggugcagauggucacu

SEQ ID NO: 5574 - RNA, 21 nt, Artificial Sequence
  Synthetic
uugagggugcagauggucacu

SEQ ID NO: 5575 - RNA, 22 nt, Artificial Sequence
  Synthetic
auugagggugcagauggucacu

SEQ ID NO: 5576 - RNA, 23 nt, Artificial Sequence
  Synthetic
gauugagggugcagauggucacu

SEQ ID NO: 5577 - RNA, 24 nt, Artificial Sequence
  Synthetic
ggauugagggugcagauggucacu

SEQ ID NO: 5578 - RNA, 18 nt, Artificial Sequence
  Synthetic
ugagcccuggaguggacu

SEQ ID NO: 5579 - RNA, 19 nt, Artificial Sequence
  Synthetic
augagcccuggaguggacu

SEQ ID NO: 5580 - RNA, 21 nt, Artificial Sequence
  Synthetic
ucaugagcccuggaguggacu

SEQ ID NO: 5581 - RNA, 22 nt, Artificial Sequence
  Synthetic
uucaugagcccuggaguggacu

SEQ ID NO: 5582 - RNA, 23 nt, Artificial Sequence
  Synthetic
cuucaugagcccuggaguggacu

SEQ ID NO: 5583 - RNA, 24 nt, Artificial Sequence
  Synthetic
ccuucaugagcccuggaguggacu

SEQ ID NO: 5584 - RNA, 18 nt, Artificial Sequence
  Synthetic
gcucaugauaccuccccu

SEQ ID NO: 5585 - RNA, 19 nt, Artificial Sequence
  Synthetic
ugcucaugauaccuccccu

SEQ ID NO: 5586 - RNA, 21 nt, Artificial Sequence
  Synthetic
acugcucaugauaccuccccu

SEQ ID NO: 5587 - RNA, 22 nt, Artificial Sequence
  Synthetic
uacugcucaugauaccuccccu

SEQ ID NO: 5588 - RNA, 23 nt, Artificial Sequence
  Synthetic
auacugcucaugauaccuccccu

SEQ ID NO: 5589 - RNA, 24 nt, Artificial Sequence
  Synthetic
gauacugcucaugauaccuccccu

SEQ ID NO: 5590 - RNA, 18 nt, Artificial Sequence
  Synthetic
cagggucaaggcugagcu

SEQ ID NO: 5591 - RNA, 19 nt, Artificial Sequence
  Synthetic
ucagggucaaggcugagcu

SEQ ID NO: 5592 - RNA, 20 nt, Artificial Sequence
  Synthetic
gucagggucaaggcugagcu

SEQ ID NO: 5593 - RNA, 21 nt, Artificial Sequence
  Synthetic
ggucagggucaaggcugagcu

SEQ ID NO: 5594 - RNA, 22 nt, Artificial Sequence
  Synthetic
gggucagggucaaggcugagcu

SEQ ID NO: 5595 - RNA, 23 nt, Artificial Sequence
  Synthetic
agggucagggucaaggcugagcu

SEQ ID NO: 5596 - RNA, 24 nt, Artificial Sequence
  Synthetic
aagggucagggucaaggcugagcu

SEQ ID NO: 5597 - RNA, 18 nt, Artificial Sequence
  Synthetic
ucuucaugcgguugugcu

SEQ ID NO: 5598 - RNA, 19 nt, Artificial Sequence
  Synthetic
gucuucaugcgguugugcu

SEQ ID NO: 5599 - RNA, 21 nt, Artificial Sequence
  Synthetic
ccgucuucaugcgguugugcu

SEQ ID NO: 5600 - RNA, 22 nt, Artificial Sequence
  Synthetic
gccgucuucaugcgguugugcu

SEQ ID NO: 5601 - RNA, 23 nt, Artificial Sequence
  Synthetic
ggccgucuucaugcgguugugcu

SEQ ID NO: 5602 - RNA, 24 nt, Artificial Sequence
  Synthetic
aggccgucuucaugcgguugugcu

SEQ ID NO: 5603 - RNA, 18 nt, Artificial Sequence
  Synthetic
ggguagcugaaguacucu

SEQ ID NO: 5604 - RNA, 19 nt, Artificial Sequence
  Synthetic
gggguagcugaaguacucu

SEQ ID NO: 5605 - RNA, 21 nt, Artificial Sequence
  Synthetic
acgggguagcugaaguacucu

SEQ ID NO: 5606 - RNA, 22 nt, Artificial Sequence
  Synthetic
gacgggguagcugaaguacucu

SEQ ID NO: 5607 - RNA, 23 nt, Artificial Sequence
  Synthetic
ugacgggguagcugaaguacucu

SEQ ID NO: 5608 - RNA, 24 nt, Artificial Sequence
  Synthetic
cugacgggguagcugaaguacucu

SEQ ID NO: 5609 - RNA, 18 nt, Artificial Sequence
  Synthetic
ugcuggggcgccgcaggu

SEQ ID NO: 5610 - RNA, 19 nt, Artificial Sequence
  Synthetic
cugcuggggcgccgcaggu

SEQ ID NO: 5611 - RNA, 21 nt, Artificial Sequence
  Synthetic
ggcugcuggggcgccgcaggu

SEQ ID NO: 5612 - RNA, 22 nt, Artificial Sequence
  Synthetic
gggcugcuggggcgccgcaggu

SEQ ID NO: 5613 - RNA, 23 nt, Artificial Sequence
  Synthetic
ugggcugcuggggcgccgcaggu

SEQ ID NO: 5614 - RNA, 24 nt, Artificial Sequence
  Synthetic
gugggcugcuggggcgccgcaggu

SEQ ID NO: 5615 - RNA, 18 nt, Artificial Sequence
  Synthetic
acucgaagagcucucggu

SEQ ID NO: 5616 - RNA, 19 nt, Artificial Sequence
  Synthetic
aacucgaagagcucucggu

SEQ ID NO: 5617 - RNA, 21 nt, Artificial Sequence
  Synthetic
agaacucgaagagcucucggu

SEQ ID NO: 5618 - RNA, 22 nt, Artificial Sequence
  Synthetic
aagaacucgaagagcucucggu

SEQ ID NO: 5619 - RNA, 23 nt, Artificial Sequence
  Synthetic
gaagaacucgaagagcucucggu

SEQ ID NO: 5620 - RNA, 24 nt, Artificial Sequence
  Synthetic
agaagaacucgaagagcucucggu

SEQ ID NO: 5621 - RNA, 18 nt, Artificial Sequence
  Synthetic
cccuccaugagaccuggu

SEQ ID NO: 5622 - RNA, 19 nt, Artificial Sequence
  Synthetic
ccccuccaugagaccuggu

SEQ ID NO: 5623 - RNA, 21 nt, Artificial Sequence
  Synthetic
uuccccuccaugagaccuggu

SEQ ID NO: 5624 - RNA, 22 nt, Artificial Sequence
  Synthetic
guuccccuccaugagaccuggu

SEQ ID NO: 5625 - RNA, 23 nt, Artificial Sequence
  Synthetic
uguuccccuccaugagaccuggu

SEQ ID NO: 5626 - RNA, 24 nt, Artificial Sequence
  Synthetic
uuguuccccuccaugagaccuggu

SEQ ID NO: 5627 - RNA, 18 nt, Artificial Sequence
  Synthetic
ugagccccggaguggauu

SEQ ID NO: 5628 - RNA, 19 nt, Artificial Sequence
  Synthetic
augagccccggaguggauu

SEQ ID NO: 5629 - RNA, 21 nt, Artificial Sequence
  Synthetic
ucaugagccccggaguggauu

SEQ ID NO: 5630 - RNA, 22 nt, Artificial Sequence
  Synthetic
uucaugagccccggaguggauu

SEQ ID NO: 5631 - RNA, 23 nt, Artificial Sequence
  Synthetic
cuucaugagccccggaguggauu

SEQ ID NO: 5632 - RNA, 24 nt, Artificial Sequence
  Synthetic
ccuucaugagccccggaguggauu

SEQ ID NO: 5633 - RNA, 18 nt, Artificial Sequence
  Synthetic
gcuggggcgccgcagguu

SEQ ID NO: 5634 - RNA, 19 nt, Artificial Sequence
  Synthetic
ugcuggggcgccgcagguu

SEQ ID NO: 5635 - RNA, 21 nt, Artificial Sequence
  Synthetic
gcugcuggggcgccgcagguu

SEQ ID NO: 5636 - RNA, 22 nt, Artificial Sequence
  Synthetic
ggcugcuggggcgccgcagguu

SEQ ID NO: 5637 - RNA, 23 nt, Artificial Sequence
  Synthetic
gggcugcuggggcgccgcagguu

SEQ ID NO: 5638 - RNA, 24 nt, Artificial Sequence
  Synthetic
ugggcugcuggggcgccgcagguu

SEQ ID NO: 5639 - RNA, 18 nt, Artificial Sequence
  Synthetic
caguaucaagguaagcaa

SEQ ID NO: 5640 - RNA, 19 nt, Artificial Sequence
  Synthetic
gcaguaucaagguaagcaa

SEQ ID NO: 5641 - RNA, 21 nt, Artificial Sequence
  Synthetic
gagcaguaucaagguaagcaa

SEQ ID NO: 5642 - RNA, 22 nt, Artificial Sequence
  Synthetic
ugagcaguaucaagguaagcaa

SEQ ID NO: 5643 - RNA, 23 nt, Artificial Sequence
  Synthetic
augagcaguaucaagguaagcaa

SEQ ID NO: 5644 - RNA, 24 nt, Artificial Sequence
  Synthetic
caugagcaguaucaagguaagcaa

SEQ ID NO: 5645 - RNA, 18 nt, Artificial Sequence
  Synthetic
cacuccagggcucaugaa

SEQ ID NO: 5646 - RNA, 19 nt, Artificial Sequence
  Synthetic
ccacuccagggcucaugaa

SEQ ID NO: 5647 - RNA, 21 nt, Artificial Sequence
  Synthetic
guccacuccagggcucaugaa

SEQ ID NO: 5648 - RNA, 22 nt, Artificial Sequence
  Synthetic
aguccacuccagggcucaugaa

SEQ ID NO: 5649 - RNA, 23 nt, Artificial Sequence
  Synthetic
caguccacuccagggcucaugaa

SEQ ID NO: 5650 - RNA, 24 nt, Artificial Sequence
  Synthetic
acaguccacuccagggcucaugaa

SEQ ID NO: 5651 - RNA, 18 nt, Artificial Sequence
  Synthetic
cacuccggggcucaugaa

SEQ ID NO: 5652 - RNA, 19 nt, Artificial Sequence
  Synthetic
ccacuccggggcucaugaa

SEQ ID NO: 5653 - RNA, 21 nt, Artificial Sequence
  Synthetic
auccacuccggggcucaugaa

SEQ ID NO: 5654 - RNA, 22 nt, Artificial Sequence
  Synthetic
aauccacuccggggcucaugaa

SEQ ID NO: 5655 - RNA, 23 nt, Artificial Sequence
  Synthetic
caauccacuccggggcucaugaa

SEQ ID NO: 5656 - RNA, 24 nt, Artificial Sequence
  Synthetic
ccaauccacuccggggcucaugaa

SEQ ID NO: 5657 - RNA, 18 nt, Artificial Sequence
  Synthetic
gcaguaucaagguaagca

SEQ ID NO: 5658 - RNA, 19 nt, Artificial Sequence
  Synthetic
agcaguaucaagguaagca

SEQ ID NO: 5659 - RNA, 21 nt, Artificial Sequence
  Synthetic
ugagcaguaucaagguaagca

SEQ ID NO: 5660 - RNA, 22 nt, Artificial Sequence
  Synthetic
augagcaguaucaagguaagca

SEQ ID NO: 5661 - RNA, 23 nt, Artificial Sequence
  Synthetic
caugagcaguaucaagguaagca

SEQ ID NO: 5662 - RNA, 24 nt, Artificial Sequence
  Synthetic
ucaugagcaguaucaagguaagca

SEQ ID NO: 5663 - RNA, 18 nt, Artificial Sequence
  Synthetic
agcccauaccaggucuca

SEQ ID NO: 5664 - RNA, 19 nt, Artificial Sequence
  Synthetic
cagcccauaccaggucuca

SEQ ID NO: 5665 - RNA, 21 nt, Artificial Sequence
  Synthetic
ugcagcccauaccaggucuca

SEQ ID NO: 5666 - RNA, 22 nt, Artificial Sequence
  Synthetic
cugcagcccauaccaggucuca

SEQ ID NO: 5667 - RNA, 23 nt, Artificial Sequence
  Synthetic
ucugcagcccauaccaggucuca

SEQ ID NO: 5668 - RNA, 24 nt, Artificial Sequence
  Synthetic
cucugcagcccauaccaggucuca

SEQ ID NO: 5669 - RNA, 18 nt, Artificial Sequence
  Synthetic
guuccaggggugauggga

SEQ ID NO: 5670 - RNA, 19 nt, Artificial Sequence
  Synthetic
gguuccaggggugauggga

SEQ ID NO: 5671 - RNA, 20 nt, Artificial Sequence
  Synthetic
ggguuccaggggugauggga

SEQ ID NO: 5672 - RNA, 21 nt, Artificial Sequence
  Synthetic
cggguuccaggggugauggga

SEQ ID NO: 5673 - RNA, 22 nt, Artificial Sequence
  Synthetic
ucggguuccaggggugauggga

SEQ ID NO: 5674 - RNA, 23 nt, Artificial Sequence
  Synthetic
cucggguuccaggggugauggga

SEQ ID NO: 5675 - RNA, 24 nt, Artificial Sequence
  Synthetic
acucggguuccaggggugauggga

SEQ ID NO: 5676 - RNA, 18 nt, Artificial Sequence
  Synthetic
cauaccaggucucaugga

SEQ ID NO: 5677 - RNA, 19 nt, Artificial Sequence
  Synthetic
ccauaccaggucucaugga

SEQ ID NO: 5678 - RNA, 21 nt, Artificial Sequence
  Synthetic
gcccauaccaggucucaugga

SEQ ID NO: 5679 - RNA, 22 nt, Artificial Sequence
  Synthetic
agcccauaccaggucucaugga

SEQ ID NO: 5680 - RNA, 23 nt, Artificial Sequence
  Synthetic
cagcccauaccaggucucaugga

SEQ ID NO: 5681 - RNA, 24 nt, Artificial Sequence
  Synthetic
gcagcccauaccaggucucaugga

SEQ ID NO: 5682 - RNA, 18 nt, Artificial Sequence
  Synthetic
ccacuccagggcucauga

SEQ ID NO: 5683 - RNA, 19 nt, Artificial Sequence
  Synthetic
uccacuccagggcucauga

SEQ ID NO: 5684 - RNA, 21 nt, Artificial Sequence
  Synthetic
aguccacuccagggcucauga

SEQ ID NO: 5685 - RNA, 22 nt, Artificial Sequence
  Synthetic
caguccacuccagggcucauga

SEQ ID NO: 5686 - RNA, 23 nt, Artificial Sequence
  Synthetic
acaguccacuccagggcucauga

SEQ ID NO: 5687 - RNA, 24 nt, Artificial Sequence
  Synthetic
cacaguccacuccagggcucauga

SEQ ID NO: 5688 - RNA, 18 nt, Artificial Sequence
  Synthetic
ccacuccggggcucauga

SEQ ID NO: 5689 - RNA, 19 nt, Artificial Sequence
  Synthetic
uccacuccggggcucauga

SEQ ID NO: 5690 - RNA, 21 nt, Artificial Sequence
  Synthetic
aauccacuccggggcucauga

SEQ ID NO: 5691 - RNA, 22 nt, Artificial Sequence
  Synthetic
caauccacuccggggcucauga

SEQ ID NO: 5692 - RNA, 23 nt, Artificial Sequence
  Synthetic
ccaauccacuccggggcucauga

SEQ ID NO: 5693 - RNA, 24 nt, Artificial Sequence
  Synthetic
cccaauccacuccggggcucauga

SEQ ID NO: 5694 - RNA, 18 nt, Artificial Sequence
  Synthetic
cucggguuccagggguga

SEQ ID NO: 5695 - RNA, 19 nt, Artificial Sequence
  Synthetic
acucggguuccagggguga

SEQ ID NO: 5696 - RNA, 21 nt, Artificial Sequence
  Synthetic
ucacucggguuccagggguga

SEQ ID NO: 5697 - RNA, 22 nt, Artificial Sequence
  Synthetic
cucacucggguuccagggguga

SEQ ID NO: 5698 - RNA, 23 nt, Artificial Sequence
  Synthetic
ccucacucggguuccagggguga

SEQ ID NO: 5699 - RNA, 24 nt, Artificial Sequence
  Synthetic
gccucacucggguuccagggguga

SEQ ID NO: 5700 - RNA, 18 nt, Artificial Sequence
  Synthetic
cgaguuccaccgcuccua

SEQ ID NO: 5701 - RNA, 19 nt, Artificial Sequence
  Synthetic
ucgaguuccaccgcuccua

SEQ ID NO: 5702 - RNA, 21 nt, Artificial Sequence
  Synthetic
gaucgaguuccaccgcuccua

SEQ ID NO: 5703 - RNA, 22 nt, Artificial Sequence
  Synthetic
ugaucgaguuccaccgcuccua

SEQ ID NO: 5704 - RNA, 23 nt, Artificial Sequence
  Synthetic
cugaucgaguuccaccgcuccua

SEQ ID NO: 5705 - RNA, 24 nt, Artificial Sequence
  Synthetic
ccugaucgaguuccaccgcuccua

SEQ ID NO: 5706 - RNA, 18 nt, Artificial Sequence
  Synthetic
cucaacaucaaccucaac

SEQ ID NO: 5707 - RNA, 19 nt, Artificial Sequence
  Synthetic
ccucaacaucaaccucaac

SEQ ID NO: 5708 - RNA, 21 nt, Artificial Sequence
  Synthetic
agccucaacaucaaccucaac

SEQ ID NO: 5709 - RNA, 22 nt, Artificial Sequence
  Synthetic
cagccucaacaucaaccucaac

SEQ ID NO: 5710 - RNA, 23 nt, Artificial Sequence
  Synthetic
ucagccucaacaucaaccucaac

SEQ ID NO: 5711 - RNA, 24 nt, Artificial Sequence
  Synthetic
gucagccucaacaucaaccucaac

SEQ ID NO: 5712 - RNA, 18 nt, Artificial Sequence
  Synthetic
gugggcgcagggugggac

SEQ ID NO: 5713 - RNA, 19 nt, Artificial Sequence
  Synthetic
ugugggcgcagggugggac

SEQ ID NO: 5714 - RNA, 20 nt, Artificial Sequence
  Synthetic
augugggcgcagggugggac

SEQ ID NO: 5715 - RNA, 21 nt, Artificial Sequence
  Synthetic
aaugugggcgcagggugggac

SEQ ID NO: 5716 - RNA, 22 nt, Artificial Sequence
  Synthetic
gaaugugggcgcagggugggac

SEQ ID NO: 5717 - RNA, 23 nt, Artificial Sequence
  Synthetic
agaaugugggcgcagggugggac

SEQ ID NO: 5718 - RNA, 24 nt, Artificial Sequence
  Synthetic
gagaaugugggcgcagggugggac

SEQ ID NO: 5719 - RNA, 18 nt, Artificial Sequence
  Synthetic
aguuccaccgcuccuacc

SEQ ID NO: 5720 - RNA, 19 nt, Artificial Sequence
  Synthetic
gaguuccaccgcuccuacc

SEQ ID NO: 5721 - RNA, 21 nt, Artificial Sequence
  Synthetic
ucgaguuccaccgcuccuacc

SEQ ID NO: 5722 - RNA, 22 nt, Artificial Sequence
  Synthetic
aucgaguuccaccgcuccuacc

SEQ ID NO: 5723 - RNA, 23 nt, Artificial Sequence
  Synthetic
gaucgaguuccaccgcuccuacc

SEQ ID NO: 5724 - RNA, 24 nt, Artificial Sequence
  Synthetic
ugaucgaguuccaccgcuccuacc

SEQ ID NO: 5725 - RNA, 18 nt, Artificial Sequence
  Synthetic
gagagggcacucagggcc

SEQ ID NO: 5726 - RNA, 19 nt, Artificial Sequence
  Synthetic
ggagagggcacucagggcc

SEQ ID NO: 5727 - RNA, 20 nt, Artificial Sequence
  Synthetic
gggagagggcacucagggcc

SEQ ID NO: 5728 - RNA, 21 nt, Artificial Sequence
  Synthetic
ugggagagggcacucagggcc

SEQ ID NO: 5729 - RNA, 22 nt, Artificial Sequence
  Synthetic
augggagagggcacucagggcc

SEQ ID NO: 5730 - RNA, 23 nt, Artificial Sequence
  Synthetic
gaugggagagggcacucagggcc

SEQ ID NO: 5731 - RNA, 24 nt, Artificial Sequence
  Synthetic
ugaugggagagggcacucagggcc

SEQ ID NO: 5732 - RNA, 18 nt, Artificial Sequence
  Synthetic
aggagcaggggcugggcc

SEQ ID NO: 5733 - RNA, 19 nt, Artificial Sequence
  Synthetic
gaggagcaggggcugggcc

SEQ ID NO: 5734 - RNA, 21 nt, Artificial Sequence
  Synthetic
gugaggagcaggggcugggcc

SEQ ID NO: 5735 - RNA, 22 nt, Artificial Sequence
  Synthetic
cgugaggagcaggggcugggcc

SEQ ID NO: 5736 - RNA, 23 nt, Artificial Sequence
  Synthetic
gcgugaggagcaggggcugggcc

SEQ ID NO: 5737 - RNA, 24 nt, Artificial Sequence
  Synthetic
agcgugaggagcaggggcugggcc

SEQ ID NO: 5738 - RNA, 18 nt, Artificial Sequence
  Synthetic
ugggacaugggcauggcc

SEQ ID NO: 5739 - RNA, 19 nt, Artificial Sequence
  Synthetic
gugggacaugggcauggcc

SEQ ID NO: 5740 - RNA, 21 nt, Artificial Sequence
  Synthetic
gggugggacaugggcauggcc

SEQ ID NO: 5741 - RNA, 22 nt, Artificial Sequence
  Synthetic
agggugggacaugggcauggcc

SEQ ID NO: 5742 - RNA, 23 nt, Artificial Sequence
  Synthetic
cagggugggacaugggcauggcc

SEQ ID NO: 5743 - RNA, 24 nt, Artificial Sequence
  Synthetic
gcagggugggacaugggcauggcc

SEQ ID NO: 5744 - RNA, 18 nt, Artificial Sequence
  Synthetic
ucaugaaggggaacaagc

SEQ ID NO: 5745 - RNA, 19 nt, Artificial Sequence
  Synthetic
cucaugaaggggaacaagc

SEQ ID NO: 5746 - RNA, 21 nt, Artificial Sequence
  Synthetic
ggcucaugaaggggaacaagc

SEQ ID NO: 5747 - RNA, 22 nt, Artificial Sequence
  Synthetic
gggcucaugaaggggaacaagc

SEQ ID NO: 5748 - RNA, 23 nt, Artificial Sequence
  Synthetic
agggcucaugaaggggaacaagc

SEQ ID NO: 5749 - RNA, 24 nt, Artificial Sequence
  Synthetic
cagggcucaugaaggggaacaagc

SEQ ID NO: 5750 - RNA, 23 nt, Artificial Sequence
  Synthetic
ggggcucaugaaggggaacaagc

SEQ ID NO: 5751 - RNA, 24 nt, Artificial Sequence
  Synthetic
cggggcucaugaaggggaacaagc

SEQ ID NO: 5752 - RNA, 18 nt, Artificial Sequence
  Synthetic
ucauggaggggaacaagc

SEQ ID NO: 5753 - RNA, 19 nt, Artificial Sequence
  Synthetic
cucauggaggggaacaagc

SEQ ID NO: 5754 - RNA, 21 nt, Artificial Sequence
  Synthetic
gucucauggaggggaacaagc

SEQ ID NO: 5755 - RNA, 22 nt, Artificial Sequence
  Synthetic
ggucucauggaggggaacaagc

SEQ ID NO: 5756 - RNA, 23 nt, Artificial Sequence
  Synthetic
aggucucauggaggggaacaagc

SEQ ID NO: 5757 - RNA, 24 nt, Artificial Sequence
  Synthetic
caggucucauggaggggaacaagc

SEQ ID NO: 5758 - RNA, 18 nt, Artificial Sequence
  Synthetic
agcaguaucaagguaagc

SEQ ID NO: 5759 - RNA, 19 nt, Artificial Sequence
  Synthetic
gagcaguaucaagguaagc

SEQ ID NO: 5760 - RNA, 20 nt, Artificial Sequence
  Synthetic
ugagcaguaucaagguaagc

SEQ ID NO: 5761 - RNA, 21 nt, Artificial Sequence
  Synthetic
augagcaguaucaagguaagc

SEQ ID NO: 5762 - RNA, 22 nt, Artificial Sequence
  Synthetic
caugagcaguaucaagguaagc

SEQ ID NO: 5763 - RNA, 23 nt, Artificial Sequence
  Synthetic
ucaugagcaguaucaagguaagc

SEQ ID NO: 5764 - RNA, 24 nt, Artificial Sequence
  Synthetic
aucaugagcaguaucaagguaagc

SEQ ID NO: 5765 - RNA, 18 nt, Artificial Sequence
  Synthetic
ggaacaagcgugaggagc

SEQ ID NO: 5766 - RNA, 19 nt, Artificial Sequence
  Synthetic
gggaacaagcgugaggagc

SEQ ID NO: 5767 - RNA, 21 nt, Artificial Sequence
  Synthetic
aggggaacaagcgugaggagc

SEQ ID NO: 5768 - RNA, 22 nt, Artificial Sequence
  Synthetic
aaggggaacaagcgugaggagc

SEQ ID NO: 5769 - RNA, 23 nt, Artificial Sequence
  Synthetic
gaaggggaacaagcgugaggagc

SEQ ID NO: 5770 - RNA, 24 nt, Artificial Sequence
  Synthetic
ugaaggggaacaagcgugaggagc

SEQ ID NO: 5771 - RNA, 18 nt, Artificial Sequence
  Synthetic
ugcucccagcacaaccgc

SEQ ID NO: 5772 - RNA, 19 nt, Artificial Sequence
  Synthetic
gugcucccagcacaaccgc

SEQ ID NO: 5773 - RNA, 21 nt, Artificial Sequence
  Synthetic
gugugcucccagcacaaccgc

SEQ ID NO: 5774 - RNA, 22 nt, Artificial Sequence
  Synthetic
ggugugcucccagcacaaccgc

SEQ ID NO: 5775 - RNA, 23 nt, Artificial Sequence
  Synthetic
uggugugcucccagcacaaccgc

SEQ ID NO: 5776 - RNA, 24 nt, Artificial Sequence
  Synthetic
cuggugugcucccagcacaaccgc

SEQ ID NO: 5777 - RNA, 18 nt, Artificial Sequence
  Synthetic
gugggacaugggcauggc

SEQ ID NO: 5778 - RNA, 19 nt, Artificial Sequence
  Synthetic
ggugggacaugggcauggc

SEQ ID NO: 5779 - RNA, 20 nt, Artificial Sequence
  Synthetic
gggugggacaugggcauggc

SEQ ID NO: 5780 - RNA, 21 nt, Artificial Sequence
  Synthetic
agggugggacaugggcauggc

SEQ ID NO: 5781 - RNA, 22 nt, Artificial Sequence
  Synthetic
cagggugggacaugggcauggc

SEQ ID NO: 5782 - RNA, 23 nt, Artificial Sequence
  Synthetic
gcagggugggacaugggcauggc

SEQ ID NO: 5783 - RNA, 24 nt, Artificial Sequence
  Synthetic
cgcagggugggacaugggcauggc

SEQ ID NO: 5784 - RNA, 18 nt, Artificial Sequence
  Synthetic
cuuccaaggggagguauc

SEQ ID NO: 5785 - RNA, 19 nt, Artificial Sequence
  Synthetic
ccuuccaaggggagguauc

SEQ ID NO: 5786 - RNA, 20 nt, Artificial Sequence
  Synthetic
cccuuccaaggggagguauc

SEQ ID NO: 5787 - RNA, 21 nt, Artificial Sequence
  Synthetic
ucccuuccaaggggagguauc

SEQ ID NO: 5788 - RNA, 22 nt, Artificial Sequence
  Synthetic
gucccuuccaaggggagguauc

SEQ ID NO: 5789 - RNA, 23 nt, Artificial Sequence
  Synthetic
ugucccuuccaaggggagguauc

SEQ ID NO: 5790 - RNA, 24 nt, Artificial Sequence
  Synthetic
cugucccuuccaaggggagguauc

SEQ ID NO: 5791 - RNA, 18 nt, Artificial Sequence
  Synthetic
gcucuccccaauccacuc

SEQ ID NO: 5792 - RNA, 19 nt, Artificial Sequence
  Synthetic
ugcucuccccaauccacuc

SEQ ID NO: 5793 - RNA, 21 nt, Artificial Sequence
  Synthetic
cuugcucuccccaauccacuc

SEQ ID NO: 5794 - RNA, 22 nt, Artificial Sequence
  Synthetic
ccuugcucuccccaauccacuc

SEQ ID NO: 5795 - RNA, 23 nt, Artificial Sequence
  Synthetic
cccuugcucuccccaauccacuc

SEQ ID NO: 5796 - RNA, 24 nt, Artificial Sequence
  Synthetic
acccuugcucuccccaauccacuc

SEQ ID NO: 5797 - RNA, 18 nt, Artificial Sequence
  Synthetic
gcccuccacaguccacuc

SEQ ID NO: 5798 - RNA, 19 nt, Artificial Sequence
  Synthetic
agcccuccacaguccacuc

SEQ ID NO: 5799 - RNA, 21 nt, Artificial Sequence
  Synthetic
cuagcccuccacaguccacuc

SEQ ID NO: 5800 - RNA, 22 nt, Artificial Sequence
  Synthetic
ucuagcccuccacaguccacuc

SEQ ID NO: 5801 - RNA, 23 nt, Artificial Sequence
  Synthetic
cucuagcccuccacaguccacuc

SEQ ID NO: 5802 - RNA, 24 nt, Artificial Sequence
  Synthetic
acucuagcccuccacaguccacuc

SEQ ID NO: 5803 - RNA, 18 nt, Artificial Sequence
  Synthetic
caguccacuccagggcuc

SEQ ID NO: 5804 - RNA, 19 nt, Artificial Sequence
  Synthetic
acaguccacuccagggcuc

SEQ ID NO: 5805 - RNA, 21 nt, Artificial Sequence
  Synthetic
ccacaguccacuccagggcuc

SEQ ID NO: 5806 - RNA, 22 nt, Artificial Sequence
  Synthetic
uccacaguccacuccagggcuc

SEQ ID NO: 5807 - RNA, 23 nt, Artificial Sequence
  Synthetic
cuccacaguccacuccagggcuc

SEQ ID NO: 5808 - RNA, 24 nt, Artificial Sequence
  Synthetic
ccuccacaguccacuccagggcuc

SEQ ID NO: 5809 - RNA, 18 nt, Artificial Sequence
  Synthetic
caauccacuccggggcuc

SEQ ID NO: 5810 - RNA, 19 nt, Artificial Sequence
  Synthetic
ccaauccacuccggggcuc

SEQ ID NO: 5811 - RNA, 20 nt, Artificial Sequence
  Synthetic
cccaauccacuccggggcuc

SEQ ID NO: 5812 - RNA, 21 nt, Artificial Sequence
  Synthetic
ccccaauccacuccggggcuc

SEQ ID NO: 5813 - RNA, 22 nt, Artificial Sequence
  Synthetic
uccccaauccacuccggggcuc

SEQ ID NO: 5814 - RNA, 23 nt, Artificial Sequence
  Synthetic
cuccccaauccacuccggggcuc

SEQ ID NO: 5815 - RNA, 24 nt, Artificial Sequence
  Synthetic
ucuccccaauccacuccggggcuc

SEQ ID NO: 5816 - RNA, 18 nt, Artificial Sequence
  Synthetic
cagcccauaccaggucuc

SEQ ID NO: 5817 - RNA, 19 nt, Artificial Sequence
  Synthetic
gcagcccauaccaggucuc

SEQ ID NO: 5818 - RNA, 21 nt, Artificial Sequence
  Synthetic
cugcagcccauaccaggucuc

SEQ ID NO: 5819 - RNA, 22 nt, Artificial Sequence
  Synthetic
ucugcagcccauaccaggucuc

SEQ ID NO: 5820 - RNA, 23 nt, Artificial Sequence
  Synthetic
cucugcagcccauaccaggucuc

SEQ ID NO: 5821 - RNA, 24 nt, Artificial Sequence
  Synthetic
ccucugcagcccauaccaggucuc

SEQ ID NO: 5822 - RNA, 18 nt, Artificial Sequence
  Synthetic
gcagccucacucggguuc

SEQ ID NO: 5823 - RNA, 19 nt, Artificial Sequence
  Synthetic
ggcagccucacucggguuc

SEQ ID NO: 5824 - RNA, 20 nt, Artificial Sequence
  Synthetic
gggcagccucacucggguuc

SEQ ID NO: 5825 - RNA, 21 nt, Artificial Sequence
  Synthetic
ggggcagccucacucggguuc

SEQ ID NO: 5826 - RNA, 22 nt, Artificial Sequence
  Synthetic
aggggcagccucacucggguuc

SEQ ID NO: 5827 - RNA, 23 nt, Artificial Sequence
  Synthetic
caggggcagccucacucggguuc

SEQ ID NO: 5828 - RNA, 24 nt, Artificial Sequence
  Synthetic
ccaggggcagccucacucggguuc

SEQ ID NO: 5829 - RNA, 18 nt, Artificial Sequence
  Synthetic
cucaugaaggggaacaag

SEQ ID NO: 5830 - RNA, 19 nt, Artificial Sequence
  Synthetic
gcucaugaaggggaacaag

SEQ ID NO: 5831 - RNA, 20 nt, Artificial Sequence
  Synthetic
ggcucaugaaggggaacaag

SEQ ID NO: 5832 - RNA, 21 nt, Artificial Sequence
  Synthetic
gggcucaugaaggggaacaag

SEQ ID NO: 5833 - RNA, 22 nt, Artificial Sequence
  Synthetic
ggggcucaugaaggggaacaag

SEQ ID NO: 5834 - RNA, 23 nt, Artificial Sequence
  Synthetic
cggggcucaugaaggggaacaag

SEQ ID NO: 5835 - RNA, 24 nt, Artificial Sequence
  Synthetic
ccggggcucaugaaggggaacaag

SEQ ID NO: 5836 - RNA, 18 nt, Artificial Sequence
  Synthetic
cucauggaggggaacaag

SEQ ID NO: 5837 - RNA, 19 nt, Artificial Sequence
  Synthetic
ucucauggaggggaacaag

SEQ ID NO: 5838 - RNA, 21 nt, Artificial Sequence
  Synthetic
ggucucauggaggggaacaag

SEQ ID NO: 5839 - RNA, 22 nt, Artificial Sequence
  Synthetic
aggucucauggaggggaacaag

SEQ ID NO: 5840 - RNA, 23 nt, Artificial Sequence
  Synthetic
caggucucauggaggggaacaag

SEQ ID NO: 5841 - RNA, 24 nt, Artificial Sequence
  Synthetic
ccaggucucauggaggggaacaag

SEQ ID NO: 5842 - RNA, 18 nt, Artificial Sequence
  Synthetic
ccagcugucccuuccaag

SEQ ID NO: 5843 - RNA, 19 nt, Artificial Sequence
  Synthetic
uccagcugucccuuccaag

SEQ ID NO: 5844 - RNA, 18 nt, Artificial Sequence
  Synthetic
acuccagggcucaugaag

SEQ ID NO: 5845 - RNA, 19 nt, Artificial Sequence
  Synthetic
cacuccagggcucaugaag

SEQ ID NO: 5846 - RNA, 21 nt, Artificial Sequence
  Synthetic
uccacuccagggcucaugaag

SEQ ID NO: 5847 - RNA, 22 nt, Artificial Sequence
  Synthetic
guccacuccagggcucaugaag

SEQ ID NO: 5848 - RNA, 23 nt, Artificial Sequence
  Synthetic
aguccacuccagggcucaugaag

SEQ ID NO: 5849 - RNA, 24 nt, Artificial Sequence
  Synthetic
caguccacuccagggcucaugaag

SEQ ID NO: 5850 - RNA, 18 nt, Artificial Sequence
  Synthetic
acuccggggcucaugaag

SEQ ID NO: 5851 - RNA, 19 nt, Artificial Sequence
  Synthetic
cacuccggggcucaugaag

SEQ ID NO: 5852 - RNA, 21 nt, Artificial Sequence
  Synthetic
uccacuccggggcucaugaag

SEQ ID NO: 5853 - RNA, 22 nt, Artificial Sequence
  Synthetic
auccacuccggggcucaugaag

SEQ ID NO: 5854 - RNA, 23 nt, Artificial Sequence
  Synthetic
aauccacuccggggcucaugaag

SEQ ID NO: 5855 - RNA, 24 nt, Artificial Sequence
  Synthetic
caauccacuccggggcucaugaag

SEQ ID NO: 5856 - RNA, 18 nt, Artificial Sequence
  Synthetic
gggaacaagcuggaggag

SEQ ID NO: 5857 - RNA, 19 nt, Artificial Sequence
  Synthetic
ggggaacaagcuggaggag

SEQ ID NO: 5858 - RNA, 21 nt, Artificial Sequence
  Synthetic
aaggggaacaagcuggaggag

SEQ ID NO: 5859 - RNA, 22 nt, Artificial Sequence
  Synthetic
gaaggggaacaagcuggaggag

SEQ ID NO: 5860 - RNA, 23 nt, Artificial Sequence
  Synthetic
ugaaggggaacaagcuggaggag

SEQ ID NO: 5861 - RNA, 24 nt, Artificial Sequence
  Synthetic
augaaggggaacaagcuggaggag

SEQ ID NO: 5862 - RNA, 21 nt, Artificial Sequence
  Synthetic
gaggggaacaagcuggaggag

SEQ ID NO: 5863 - RNA, 22 nt, Artificial Sequence
  Synthetic
ggaggggaacaagcuggaggag

SEQ ID NO: 5864 - RNA, 23 nt, Artificial Sequence
  Synthetic
uggaggggaacaagcuggaggag

SEQ ID NO: 5865 - RNA, 24 nt, Artificial Sequence
  Synthetic
auggaggggaacaagcuggaggag

SEQ ID NO: 5866 - RNA, 18 nt, Artificial Sequence
  Synthetic
gggaacaagcgugaggag

SEQ ID NO: 5867 - RNA, 19 nt, Artificial Sequence
  Synthetic
ggggaacaagcgugaggag

SEQ ID NO: 5868 - RNA, 21 nt, Artificial Sequence
  Synthetic
aaggggaacaagcgugaggag

SEQ ID NO: 5869 - RNA, 22 nt, Artificial Sequence
  Synthetic
gaaggggaacaagcgugaggag

SEQ ID NO: 5870 - RNA, 23 nt, Artificial Sequence
  Synthetic
ugaaggggaacaagcgugaggag

SEQ ID NO: 5871 - RNA, 24 nt, Artificial Sequence
  Synthetic
augaaggggaacaagcgugaggag

SEQ ID NO: 5872 - RNA, 18 nt, Artificial Sequence
  Synthetic
cagcagcccacggcggag

SEQ ID NO: 5873 - RNA, 19 nt, Artificial Sequence
  Synthetic
ccagcagcccacggcggag

SEQ ID NO: 5874 - RNA, 21 nt, Artificial Sequence
  Synthetic
ccccagcagcccacggcggag

SEQ ID NO: 5875 - RNA, 22 nt, Artificial Sequence
  Synthetic
gccccagcagcccacggcggag

SEQ ID NO: 5876 - RNA, 23 nt, Artificial Sequence
  Synthetic
cgccccagcagcccacggcggag

SEQ ID NO: 5877 - RNA, 24 nt, Artificial Sequence
  Synthetic
gcgccccagcagcccacggcggag

SEQ ID NO: 5878 - RNA, 18 nt, Artificial Sequence
  Synthetic
auaccaggucucauggag

SEQ ID NO: 5879 - RNA, 19 nt, Artificial Sequence
  Synthetic
cauaccaggucucauggag

SEQ ID NO: 5880 - RNA, 21 nt, Artificial Sequence
  Synthetic
cccauaccaggucucauggag

SEQ ID NO: 5881 - RNA, 22 nt, Artificial Sequence
  Synthetic
gcccauaccaggucucauggag

SEQ ID NO: 5882 - RNA, 23 nt, Artificial Sequence
  Synthetic
agcccauaccaggucucauggag

SEQ ID NO: 5883 - RNA, 24 nt, Artificial Sequence
  Synthetic
cagcccauaccaggucucauggag

SEQ ID NO: 5884 - RNA, 18 nt, Artificial Sequence
  Synthetic
gcgccccagcagcccacg

SEQ ID NO: 5885 - RNA, 19 nt, Artificial Sequence
  Synthetic
ggcgccccagcagcccacg

SEQ ID NO: 5886 - RNA, 21 nt, Artificial Sequence
  Synthetic
gcggcgccccagcagcccacg

SEQ ID NO: 5887 - RNA, 22 nt, Artificial Sequence
  Synthetic
ugcggcgccccagcagcccacg

SEQ ID NO: 5888 - RNA, 23 nt, Artificial Sequence
  Synthetic
cugcggcgccccagcagcccacg

SEQ ID NO: 5889 - RNA, 24 nt, Artificial Sequence
  Synthetic
ccugcggcgccccagcagcccacg

SEQ ID NO: 5890 - RNA, 18 nt, Artificial Sequence
  Synthetic
ccccagcagcccacggcg

SEQ ID NO: 5891 - RNA, 19 nt, Artificial Sequence
  Synthetic
gccccagcagcccacggcg

SEQ ID NO: 5892 - RNA, 21 nt, Artificial Sequence
  Synthetic
gcgccccagcagcccacggcg

SEQ ID NO: 5893 - RNA, 22 nt, Artificial Sequence
  Synthetic
ggcgccccagcagcccacggcg

SEQ ID NO: 5894 - RNA, 23 nt, Artificial Sequence
  Synthetic
cggcgccccagcagcccacggcg

SEQ ID NO: 5895 - RNA, 24 nt, Artificial Sequence
  Synthetic
gcggcgccccagcagcccacggcg

SEQ ID NO: 5896 - RNA, 18 nt, Artificial Sequence
  Synthetic
ggagaaugugggcgcagg

SEQ ID NO: 5897 - RNA, 19 nt, Artificial Sequence
  Synthetic
gggagaaugugggcgcagg

SEQ ID NO: 5898 - RNA, 20 nt, Artificial Sequence
  Synthetic
ugggagaaugugggcgcagg

SEQ ID NO: 5899 - RNA, 18 nt, Artificial Sequence
  Synthetic
agcagcccacggcggagg

SEQ ID NO: 5900 - RNA, 19 nt, Artificial Sequence
  Synthetic
cagcagcccacggcggagg

SEQ ID NO: 5901 - RNA, 21 nt, Artificial Sequence
  Synthetic
cccagcagcccacggcggagg

SEQ ID NO: 5902 - RNA, 22 nt, Artificial Sequence
  Synthetic
ccccagcagcccacggcggagg

SEQ ID NO: 5903 - RNA, 23 nt, Artificial Sequence
  Synthetic
gccccagcagcccacggcggagg

SEQ ID NO: 5904 - RNA, 24 nt, Artificial Sequence
  Synthetic
cgccccagcagcccacggcggagg

SEQ ID NO: 5905 - RNA, 18 nt, Artificial Sequence
  Synthetic
cgccccagcagcccacgg

SEQ ID NO: 5906 - RNA, 19 nt, Artificial Sequence
  Synthetic
gcgccccagcagcccacgg

SEQ ID NO: 5907 - RNA, 21 nt, Artificial Sequence
  Synthetic
cggcgccccagcagcccacgg

SEQ ID NO: 5908 - RNA, 22 nt, Artificial Sequence
  Synthetic
gcggcgccccagcagcccacgg

SEQ ID NO: 5909 - RNA, 23 nt, Artificial Sequence
  Synthetic
ugcggcgccccagcagcccacgg

SEQ ID NO: 5910 - RNA, 24 nt, Artificial Sequence
  Synthetic
cugcggcgccccagcagcccacgg

SEQ ID NO: 5911 - RNA, 18 nt, Artificial Sequence
  Synthetic
cccagcagcccacggcgg

SEQ ID NO: 5912 - RNA, 19 nt, Artificial Sequence
  Synthetic
ccccagcagcccacggcgg

SEQ ID NO: 5913 - RNA, 21 nt, Artificial Sequence
  Synthetic
cgccccagcagcccacggcgg

SEQ ID NO: 5914 - RNA, 22 nt, Artificial Sequence
  Synthetic
gcgccccagcagcccacggcgg

SEQ ID NO: 5915 - RNA, 23 nt, Artificial Sequence
  Synthetic
ggcgccccagcagcccacggcgg

SEQ ID NO: 5916 - RNA, 24 nt, Artificial Sequence
  Synthetic
cggcgccccagcagcccacggcgg

SEQ ID NO: 5917 - RNA, 18 nt, Artificial Sequence
  Synthetic
gagaaugugggcgcaggg

SEQ ID NO: 5918 - RNA, 19 nt, Artificial Sequence
  Synthetic
ggagaaugugggcgcaggg

SEQ ID NO: 5919 - RNA, 21 nt, Artificial Sequence
  Synthetic
ugggagaaugugggcgcaggg

SEQ ID NO: 5920 - RNA, 22 nt, Artificial Sequence
  Synthetic
gugggagaaugugggcgcaggg

SEQ ID NO: 5921 - RNA, 23 nt, Artificial Sequence
  Synthetic
agugggagaaugugggcgcaggg

SEQ ID NO: 5922 - RNA, 24 nt, Artificial Sequence
  Synthetic
gagugggagaaugugggcgcaggg

SEQ ID NO: 5923 - RNA, 18 nt, Artificial Sequence
  Synthetic
aagcgugaggagcagggg

SEQ ID NO: 5924 - RNA, 19 nt, Artificial Sequence
  Synthetic
caagcgugaggagcagggg

SEQ ID NO: 5925 - RNA, 21 nt, Artificial Sequence
  Synthetic
aacaagcgugaggagcagggg

SEQ ID NO: 5926 - RNA, 22 nt, Artificial Sequence
  Synthetic
gaacaagcgugaggagcagggg

SEQ ID NO: 5927 - RNA, 23 nt, Artificial Sequence
  Synthetic
ggaacaagcgugaggagcagggg

SEQ ID NO: 5928 - RNA, 24 nt, Artificial Sequence
  Synthetic
gggaacaagcgugaggagcagggg

SEQ ID NO: 5929 - RNA, 18 nt, Artificial Sequence
  Synthetic
ccauaccaggucucaugg

SEQ ID NO: 5930 - RNA, 19 nt, Artificial Sequence
  Synthetic
cccauaccaggucucaugg

SEQ ID NO: 5931 - RNA, 21 nt, Artificial Sequence
  Synthetic
agcccauaccaggucucaugg

SEQ ID NO: 5932 - RNA, 22 nt, Artificial Sequence
  Synthetic
cagcccauaccaggucucaugg

SEQ ID NO: 5933 - RNA, 23 nt, Artificial Sequence
  Synthetic
gcagcccauaccaggucucaugg

SEQ ID NO: 5934 - RNA, 24 nt, Artificial Sequence
  Synthetic
ugcagcccauaccaggucucaugg

SEQ ID NO: 5935 - RNA, 18 nt, Artificial Sequence
  Synthetic
ggguuccaggggugaugg

SEQ ID NO: 5936 - RNA, 19 nt, Artificial Sequence
  Synthetic
cggguuccaggggugaugg

SEQ ID NO: 5937 - RNA, 20 nt, Artificial Sequence
  Synthetic
ucggguuccaggggugaugg

SEQ ID NO: 5938 - RNA, 21 nt, Artificial Sequence
  Synthetic
cucggguuccaggggugaugg

SEQ ID NO: 5939 - RNA, 22 nt, Artificial Sequence
  Synthetic
acucggguuccaggggugaugg

SEQ ID NO: 5940 - RNA, 23 nt, Artificial Sequence
  Synthetic
cacucggguuccaggggugaugg

SEQ ID NO: 5941 - RNA, 24 nt, Artificial Sequence
  Synthetic
ucacucggguuccaggggugaugg

SEQ ID NO: 5942 - RNA, 18 nt, Artificial Sequence
  Synthetic
ugaaggggaacaagcugg

SEQ ID NO: 5943 - RNA, 19 nt, Artificial Sequence
  Synthetic
augaaggggaacaagcugg

SEQ ID NO: 5944 - RNA, 21 nt, Artificial Sequence
  Synthetic
ucaugaaggggaacaagcugg

SEQ ID NO: 5945 - RNA, 22 nt, Artificial Sequence
  Synthetic
cucaugaaggggaacaagcugg

SEQ ID NO: 5946 - RNA, 23 nt, Artificial Sequence
  Synthetic
gcucaugaaggggaacaagcugg

SEQ ID NO: 5947 - RNA, 24 nt, Artificial Sequence
  Synthetic
ggcucaugaaggggaacaagcugg

SEQ ID NO: 5948 - RNA, 18 nt, Artificial Sequence
  Synthetic
uggaggggaacaagcugg

SEQ ID NO: 5949 - RNA, 19 nt, Artificial Sequence
  Synthetic
auggaggggaacaagcugg

SEQ ID NO: 5950 - RNA, 21 nt, Artificial Sequence
  Synthetic
ucauggaggggaacaagcugg

SEQ ID NO: 5951 - RNA, 22 nt, Artificial Sequence
  Synthetic
cucauggaggggaacaagcugg

SEQ ID NO: 5952 - RNA, 23 nt, Artificial Sequence
  Synthetic
ucucauggaggggaacaagcugg

SEQ ID NO: 5953 - RNA, 24 nt, Artificial Sequence
  Synthetic
gucucauggaggggaacaagcugg

SEQ ID NO: 5954 - RNA, 18 nt, Artificial Sequence
  Synthetic
uccacuccagggcucaug

SEQ ID NO: 5955 - RNA, 19 nt, Artificial Sequence
  Synthetic
guccacuccagggcucaug

SEQ ID NO: 5956 - RNA, 21 nt, Artificial Sequence
  Synthetic
caguccacuccagggcucaug

SEQ ID NO: 5957 - RNA, 22 nt, Artificial Sequence
  Synthetic
acaguccacuccagggcucaug

SEQ ID NO: 5958 - RNA, 23 nt, Artificial Sequence
  Synthetic
cacaguccacuccagggcucaug

SEQ ID NO: 5959 - RNA, 24 nt, Artificial Sequence
  Synthetic
ccacaguccacuccagggcucaug

SEQ ID NO: 5960 - RNA, 18 nt, Artificial Sequence
  Synthetic
uccacuccggggcucaug

SEQ ID NO: 5961 - RNA, 19 nt, Artificial Sequence
  Synthetic
auccacuccggggcucaug

SEQ ID NO: 5962 - RNA, 20 nt, Artificial Sequence
  Synthetic
aauccacuccggggcucaug

SEQ ID NO: 5963 - RNA, 21 nt, Artificial Sequence
  Synthetic
caauccacuccggggcucaug

SEQ ID NO: 5964 - RNA, 22 nt, Artificial Sequence
  Synthetic
ccaauccacuccggggcucaug

SEQ ID NO: 5965 - RNA, 23 nt, Artificial Sequence
  Synthetic
cccaauccacuccggggcucaug

SEQ ID NO: 5966 - RNA, 24 nt, Artificial Sequence
  Synthetic
ccccaauccacuccggggcucaug

SEQ ID NO: 5967 - RNA, 18 nt, Artificial Sequence
  Synthetic
cccauaccaggucucaug

SEQ ID NO: 5968 - RNA, 19 nt, Artificial Sequence
  Synthetic
gcccauaccaggucucaug

SEQ ID NO: 5969 - RNA, 21 nt, Artificial Sequence
  Synthetic
cagcccauaccaggucucaug

SEQ ID NO: 5970 - RNA, 22 nt, Artificial Sequence
  Synthetic
gcagcccauaccaggucucaug

SEQ ID NO: 5971 - RNA, 23 nt, Artificial Sequence
  Synthetic
ugcagcccauaccaggucucaug

SEQ ID NO: 5972 - RNA, 24 nt, Artificial Sequence
  Synthetic
cugcagcccauaccaggucucaug

SEQ ID NO: 5973 - RNA, 18 nt, Artificial Sequence
  Synthetic
augaaggggaacaagcug

SEQ ID NO: 5974 - RNA, 19 nt, Artificial Sequence
  Synthetic
caugaaggggaacaagcug

SEQ ID NO: 5975 - RNA, 20 nt, Artificial Sequence
  Synthetic
ucaugaaggggaacaagcug

SEQ ID NO: 5976 - RNA, 21 nt, Artificial Sequence
  Synthetic
cucaugaaggggaacaagcug

SEQ ID NO: 5977 - RNA, 22 nt, Artificial Sequence
  Synthetic
gcucaugaaggggaacaagcug

SEQ ID NO: 5978 - RNA, 23 nt, Artificial Sequence
  Synthetic
ggcucaugaaggggaacaagcug

SEQ ID NO: 5979 - RNA, 24 nt, Artificial Sequence
  Synthetic
gggcucaugaaggggaacaagcug

SEQ ID NO: 5980 - RNA, 18 nt, Artificial Sequence
  Synthetic
auggaggggaacaagcug

SEQ ID NO: 5981 - RNA, 19 nt, Artificial Sequence
  Synthetic
cauggaggggaacaagcug

SEQ ID NO: 5982 - RNA, 21 nt, Artificial Sequence
  Synthetic
cucauggaggggaacaagcug

SEQ ID NO: 5983 - RNA, 22 nt, Artificial Sequence
  Synthetic
ucucauggaggggaacaagcug

SEQ ID NO: 5984 - RNA, 23 nt, Artificial Sequence
  Synthetic
gucucauggaggggaacaagcug

SEQ ID NO: 5985 - RNA, 24 nt, Artificial Sequence
  Synthetic
ggucucauggaggggaacaagcug

SEQ ID NO: 5986 - RNA, 18 nt, Artificial Sequence
  Synthetic
ugaaggggaacaagcgug

SEQ ID NO: 5987 - RNA, 19 nt, Artificial Sequence
  Synthetic
augaaggggaacaagcgug

SEQ ID NO: 5988 - RNA, 21 nt, Artificial Sequence
  Synthetic
ucaugaaggggaacaagcgug

SEQ ID NO: 5989 - RNA, 22 nt, Artificial Sequence
  Synthetic
cucaugaaggggaacaagcgug

SEQ ID NO: 5990 - RNA, 23 nt, Artificial Sequence
  Synthetic
gcucaugaaggggaacaagcgug

SEQ ID NO: 5991 - RNA, 24 nt, Artificial Sequence
  Synthetic
ggcucaugaaggggaacaagcgug

SEQ ID NO: 5992 - RNA, 18 nt, Artificial Sequence
  Synthetic
acucggguuccaggggug

SEQ ID NO: 5993 - RNA, 19 nt, Artificial Sequence
  Synthetic
cacucggguuccaggggug

SEQ ID NO: 5994 - RNA, 20 nt, Artificial Sequence
  Synthetic
ucacucggguuccaggggug

SEQ ID NO: 5995 - RNA, 21 nt, Artificial Sequence
  Synthetic
cucacucggguuccaggggug

SEQ ID NO: 5996 - RNA, 22 nt, Artificial Sequence
  Synthetic
ccucacucggguuccaggggug

SEQ ID NO: 5997 - RNA, 23 nt, Artificial Sequence
  Synthetic
gccucacucggguuccaggggug

SEQ ID NO: 5998 - RNA, 24 nt, Artificial Sequence
  Synthetic
agccucacucggguuccaggggug

SEQ ID NO: 5999 - RNA, 18 nt, Artificial Sequence
  Synthetic
ucggguuccaggggugau

SEQ ID NO: 6000 - RNA, 19 nt, Artificial Sequence
  Synthetic
cucggguuccaggggugau

SEQ ID NO: 6001 - RNA, 21 nt, Artificial Sequence
  Synthetic
cacucggguuccaggggugau

SEQ ID NO: 6002 - RNA, 22 nt, Artificial Sequence
  Synthetic
ucacucggguuccaggggugau

SEQ ID NO: 6003 - RNA, 23 nt, Artificial Sequence
  Synthetic
cucacucggguuccaggggugau

SEQ ID NO: 6004 - RNA, 24 nt, Artificial Sequence
  Synthetic
ccucacucggguuccaggggugau

SEQ ID NO: 6005 - RNA, 18 nt, Artificial Sequence
  Synthetic
ugcucuccccaauccacu

SEQ ID NO: 6006 - RNA, 19 nt, Artificial Sequence
  Synthetic
uugcucuccccaauccacu

SEQ ID NO: 6007 - RNA, 20 nt, Artificial Sequence
  Synthetic
cuugcucuccccaauccacu

SEQ ID NO: 6008 - RNA, 21 nt, Artificial Sequence
  Synthetic
ccuugcucuccccaauccacu

SEQ ID NO: 6009 - RNA, 22 nt, Artificial Sequence
  Synthetic
cccuugcucuccccaauccacu

SEQ ID NO: 6010 - RNA, 23 nt, Artificial Sequence
  Synthetic
acccuugcucuccccaauccacu

SEQ ID NO: 6011 - RNA, 24 nt, Artificial Sequence
  Synthetic
gacccuugcucuccccaauccacu

SEQ ID NO: 6012 - RNA, 18 nt, Artificial Sequence
  Synthetic
gugaugggagagggcacu

SEQ ID NO: 6013 - RNA, 19 nt, Artificial Sequence
  Synthetic
ggugaugggagagggcacu

SEQ ID NO: 6014 - RNA, 20 nt, Artificial Sequence
  Synthetic
gggugaugggagagggcacu

SEQ ID NO: 6015 - RNA, 21 nt, Artificial Sequence
  Synthetic
ggggugaugggagagggcacu

SEQ ID NO: 6016 - RNA, 22 nt, Artificial Sequence
  Synthetic
aggggugaugggagagggcacu

SEQ ID NO: 6017 - RNA, 23 nt, Artificial Sequence
  Synthetic
caggggugaugggagagggcacu

SEQ ID NO: 6018 - RNA, 24 nt, Artificial Sequence
  Synthetic
ccaggggugaugggagagggcacu

SEQ ID NO: 6019 - RNA, 18 nt, Artificial Sequence
  Synthetic
augaaggggaacaagcgu

SEQ ID NO: 6020 - RNA, 19 nt, Artificial Sequence
  Synthetic
caugaaggggaacaagcgu

SEQ ID NO: 6021 - RNA, 21 nt, Artificial Sequence
  Synthetic
cucaugaaggggaacaagcgu

SEQ ID NO: 6022 - RNA, 22 nt, Artificial Sequence
  Synthetic
gcucaugaaggggaacaagcgu

SEQ ID NO: 6023 - RNA, 23 nt, Artificial Sequence
  Synthetic
ggcucaugaaggggaacaagcgu

SEQ ID NO: 6024 - RNA, 24 nt, Artificial Sequence
  Synthetic
gggcucaugaaggggaacaagcgu

SEQ ID NO: 6025 - RNA, 18 nt, Artificial Sequence
  Synthetic
uaagcaagggaaccuggu

SEQ ID NO: 6026 - RNA, 19 nt, Artificial Sequence
  Synthetic
guaagcaagggaaccuggu

SEQ ID NO: 6027 - RNA, 20 nt, Artificial Sequence
  Synthetic
gguaagcaagggaaccuggu

SEQ ID NO: 6028 - RNA, 21 nt, Artificial Sequence
  Synthetic
agguaagcaagggaaccuggu

SEQ ID NO: 6029 - RNA, 22 nt, Artificial Sequence
  Synthetic
aagguaagcaagggaaccuggu

SEQ ID NO: 6030 - RNA, 23 nt, Artificial Sequence
  Synthetic
caagguaagcaagggaaccuggu

SEQ ID NO: 6031 - RNA, 24 nt, Artificial Sequence
  Synthetic
ucaagguaagcaagggaaccuggu

SEQ ID NO: 6032 - RNA, 18 nt, Artificial Sequence
  Synthetic
ccgcaugaagacggccuu

SEQ ID NO: 6033 - RNA, 19 nt, Artificial Sequence
  Synthetic
accgcaugaagacggccuu

SEQ ID NO: 6034 - RNA, 21 nt, Artificial Sequence
  Synthetic
caaccgcaugaagacggccuu

SEQ ID NO: 6035 - RNA, 22 nt, Artificial Sequence
  Synthetic
acaaccgcaugaagacggccuu

SEQ ID NO: 6036 - RNA, 23 nt, Artificial Sequence
  Synthetic
cacaaccgcaugaagacggccuu

SEQ ID NO: 6037 - RNA, 24 nt, Artificial Sequence
  Synthetic
gcacaaccgcaugaagacggccuu

SEQ ID NO: 6038 - RNA, 18 nt, Artificial Sequence
  Synthetic
ggcaauucggccugcuuu

SEQ ID NO: 6039 - RNA, 19 nt, Artificial Sequence
  Synthetic
uggcaauucggccugcuuu

SEQ ID NO: 6040 - RNA, 21 nt, Artificial Sequence
  Synthetic
acuggcaauucggccugcuuu

SEQ ID NO: 6041 - RNA, 22 nt, Artificial Sequence
  Synthetic
uacuggcaauucggccugcuuu

SEQ ID NO: 6042 - RNA, 23 nt, Artificial Sequence
  Synthetic
guacuggcaauucggccugcuuu

SEQ ID NO: 6043 - RNA, 24 nt, Artificial Sequence
  Synthetic
uguacuggcaauucggccugcuuu

SEQ ID NO: 6044 - RNA, 18 nt, Artificial Sequence
  Synthetic
gcaauucggccugcuuuu

SEQ ID NO: 6045 - RNA, 19 nt, Artificial Sequence
  Synthetic
ggcaauucggccugcuuuu

SEQ ID NO: 6046 - RNA, 21 nt, Artificial Sequence
  Synthetic
cuggcaauucggccugcuuuu

SEQ ID NO: 6047 - RNA, 22 nt, Artificial Sequence
  Synthetic
acuggcaauucggccugcuuuu

SEQ ID NO: 6048 - RNA, 23 nt, Artificial Sequence
  Synthetic
uacuggcaauucggccugcuuuu

SEQ ID NO: 6049 - RNA, 24 nt, Artificial Sequence
  Synthetic
guacuggcaauucggccugcuuuu

SEQ ID NO: 6050 - RNA, 22 nt, Artificial Sequence
  Synthetic
guaccugaaggggcgaggggaa

SEQ ID NO: 6051 - RNA, 23 nt, Artificial Sequence
  Synthetic
gguaccugaaggggcgaggggaa

SEQ ID NO: 6052 - RNA, 24 nt, Artificial Sequence
  Synthetic
ggguaccugaaggggcgaggggaa

SEQ ID NO: 6053 - RNA, 18 nt, Artificial Sequence
  Synthetic
gggacaaggacagagaca

SEQ ID NO: 6054 - RNA, 21 nt, Artificial Sequence
  Synthetic
gcugggacaaggacagagaca

SEQ ID NO: 6055 - RNA, 22 nt, Artificial Sequence
  Synthetic
ggcugggacaaggacagagaca

SEQ ID NO: 6056 - RNA, 19 nt, Artificial Sequence
  Synthetic
guauagcaguuuccauaca

SEQ ID NO: 6057 - RNA, 23 nt, Artificial Sequence
  Synthetic
gaaaguauagcaguuuccauaca

SEQ ID NO: 6058 - RNA, 18 nt, Artificial Sequence
  Synthetic
ggacccucaggcgcugca

SEQ ID NO: 6059 - RNA, 19 nt, Artificial Sequence
  Synthetic
gggacccucaggcgcugca

SEQ ID NO: 6060 - RNA, 21 nt, Artificial Sequence
  Synthetic
gcgggacccucaggcgcugca

SEQ ID NO: 6061 - RNA, 22 nt, Artificial Sequence
  Synthetic
ggcgggacccucaggcgcugca

SEQ ID NO: 6062 - RNA, 23 nt, Artificial Sequence
  Synthetic
gggcgggacccucaggcgcugca

SEQ ID NO: 6063 - RNA, 24 nt, Artificial Sequence
  Synthetic
ggggcgggacccucaggcgcugca

SEQ ID NO: 6064 - RNA, 21 nt, Artificial Sequence
  Synthetic
guaauuccuuaucaggaaaga

SEQ ID NO: 6065 - RNA, 23 nt, Artificial Sequence
  Synthetic
gaguaauuccuuaucaggaaaga

SEQ ID NO: 6066 - RNA, 19 nt, Artificial Sequence
  Synthetic
gagucucuggcagccucga

SEQ ID NO: 6067 - RNA, 22 nt, Artificial Sequence
  Synthetic
gcagagucucuggcagccucga

SEQ ID NO: 6068 - RNA, 23 nt, Artificial Sequence
  Synthetic
ggcagagucucuggcagccucga

SEQ ID NO: 6069 - RNA, 18 nt, Artificial Sequence
  Synthetic
gcucuccuggaagcagga

SEQ ID NO: 6070 - RNA, 24 nt, Artificial Sequence
  Synthetic
gaucaugcucuccuggaagcagga

SEQ ID NO: 6071 - RNA, 18 nt, Artificial Sequence
  Synthetic
gaagacccauuccuagga

SEQ ID NO: 6072 - RNA, 19 nt, Artificial Sequence
  Synthetic
ggaagacccauuccuagga

SEQ ID NO: 6073 - RNA, 18 nt, Artificial Sequence
  Synthetic
gcugcgggagccggccac

SEQ ID NO: 6074 - RNA, 19 nt, Artificial Sequence
  Synthetic
ggcugcgggagccggccac

SEQ ID NO: 6075 - RNA, 22 nt, Artificial Sequence
  Synthetic
gacggcugcgggagccggccac

SEQ ID NO: 6076 - RNA, 24 nt, Artificial Sequence
  Synthetic
gcgacggcugcgggagccggccac

SEQ ID NO: 6077 - RNA, 20 nt, Artificial Sequence
  Synthetic
guugcacuggacacagagac

SEQ ID NO: 6078 - RNA, 21 nt, Artificial Sequence
  Synthetic
gguugcacuggacacagagac

SEQ ID NO: 6079 - RNA, 24 nt, Artificial Sequence
  Synthetic
gcccccuggagaugggcgggggcc

SEQ ID NO: 6080 - RNA, 20 nt, Artificial Sequence
  Synthetic
guacuccacguucuggggcc

SEQ ID NO: 6081 - RNA, 19 nt, Artificial Sequence
  Synthetic
gcccagcguguccuccucc

SEQ ID NO: 6082 - RNA, 22 nt, Artificial Sequence
  Synthetic
guugcccagcguguccuccucc

SEQ ID NO: 6083 - RNA, 18 nt, Artificial Sequence
  Synthetic
ggaaggaggggaggaugc

SEQ ID NO: 6084 - RNA, 19 nt, Artificial Sequence
  Synthetic
gggaaggaggggaggaugc

SEQ ID NO: 6085 - RNA, 21 nt, Artificial Sequence
  Synthetic
gugggaaggaggggaggaugc

SEQ ID NO: 6086 - RNA, 24 nt, Artificial Sequence
  Synthetic
gaagugggaaggaggggaggaugc

SEQ ID NO: 6087 - RNA, 19 nt, Artificial Sequence
  Synthetic
gaugucaccgagggccauc

SEQ ID NO: 6088 - RNA, 20 nt, Artificial Sequence
  Synthetic
ggaugucaccgagggccauc

SEQ ID NO: 6089 - RNA, 21 nt, Artificial Sequence
  Synthetic
gggaugucaccgagggccauc

SEQ ID NO: 6090 - RNA, 24 nt, Artificial Sequence
  Synthetic
gccauaaucgcccccaagucuguc

SEQ ID NO: 6091 - RNA, 18 nt, Artificial Sequence
  Synthetic
gcugcccagguuggacag

SEQ ID NO: 6092 - RNA, 19 nt, Artificial Sequence
  Synthetic
ggcugcccagguuggacag

SEQ ID NO: 6093 - RNA, 23 nt, Artificial Sequence
  Synthetic
gccccagucacuguggacagcag

SEQ ID NO: 6094 - RNA, 24 nt, Artificial Sequence
  Synthetic
ggccccagucacuguggacagcag

SEQ ID NO: 6095 - RNA, 21 nt, Artificial Sequence
  Synthetic
gaccuaggggugcagagagag

SEQ ID NO: 6096 - RNA, 21 nt, Artificial Sequence
  Synthetic
gaauacacaccuggaagggag

SEQ ID NO: 6097 - RNA, 23 nt, Artificial Sequence
  Synthetic
gugaauacacaccuggaagggag

SEQ ID NO: 6098 - RNA, 18 nt, Artificial Sequence
  Synthetic
gcgcugcaaggggugcgg

SEQ ID NO: 6099 - RNA, 19 nt, Artificial Sequence
  Synthetic
ggcgcugcaaggggugcgg

SEQ ID NO: 6100 - RNA, 19 nt, Artificial Sequence
  Synthetic
gcagaagugggaaggaggg

SEQ ID NO: 6101 - RNA, 20 nt, Artificial Sequence
  Synthetic
ggcagaagugggaaggaggg

SEQ ID NO: 6102 - RNA, 21 nt, Artificial Sequence
  Synthetic
gggcagaagugggaaggaggg

SEQ ID NO: 6103 - RNA, 22 nt, Artificial Sequence
  Synthetic
ggggcagaagugggaaggaggg

SEQ ID NO: 6104 - RNA, 23 nt, Artificial Sequence
  Synthetic
gggggcagaagugggaaggaggg

SEQ ID NO: 6105 - RNA, 18 nt, Artificial Sequence
  Synthetic
guccuccuccagggaugg

SEQ ID NO: 6106 - RNA, 20 nt, Artificial Sequence
  Synthetic
guguccuccuccagggaugg

SEQ ID NO: 6107 - RNA, 22 nt, Artificial Sequence
  Synthetic
gcguguccuccuccagggaugg

SEQ ID NO: 6108 - RNA, 24 nt, Artificial Sequence
  Synthetic
gccucaccugcuguguguacuuug

SEQ ID NO: 6109 - RNA, 21 nt, Artificial Sequence
  Synthetic
gacccauuccuaggaaagaau

SEQ ID NO: 6110 - RNA, 24 nt, Artificial Sequence
  Synthetic
gaagacccauuccuaggaaagaau

SEQ ID NO: 6111 - RNA, 24 nt, Artificial Sequence
  Synthetic
gaccuaccgugacagagggagacu

SEQ ID NO: 6112 - RNA, 22 nt, Artificial Sequence
  Synthetic
gcgcagcaucagggacagaccu

SEQ ID NO: 6113 - RNA, 24 nt, Artificial Sequence
  Synthetic
gcgcgcagcaucagggacagaccu

SEQ ID NO: 6114 - RNA, 20 nt, Artificial Sequence
  Synthetic
gcuuauaguagcaguacccu

SEQ ID NO: 6115 - RNA, 22 nt, Artificial Sequence
  Synthetic
gagcuuauaguagcaguacccu

SEQ ID NO: 6116 - RNA, 23 nt, Artificial Sequence
  Synthetic
ggagcuuauaguagcaguacccu

SEQ ID NO: 6117 - RNA, 19 nt, Artificial Sequence
  Synthetic
gcugguagcuggucacgcu

SEQ ID NO: 6118 - RNA, 21 nt, Artificial Sequence
  Synthetic
gagcugguagcuggucacgcu

SEQ ID NO: 6119 - RNA, 23 nt, Artificial Sequence
  Synthetic
gagagcugguagcuggucacgcu

SEQ ID NO: 6120 - RNA, 21 nt, Artificial Sequence
  Synthetic
gcauggaagacauccagaggu

SEQ ID NO: 6121 - RNA, 22 nt, Artificial Sequence
  Synthetic
ggcauggaagacauccagaggu

SEQ ID NO: 6122 - RNA, 24 nt, Artificial Sequence
  Synthetic
gcuccuccagcuccucuuuaauuu

SEQ ID NO: 6123 - RNA, 18 nt, Artificial Sequence
  Synthetic
ggcaucucucuguaccca

SEQ ID NO: 6124 - RNA, 23 nt, Artificial Sequence
  Synthetic
gaacaggcaucucucuguaccca

SEQ ID NO: 6125 - RNA, 21 nt, Artificial Sequence
  Synthetic
gcuuccaggagagcaugauca

SEQ ID NO: 6126 - RNA, 23 nt, Artificial Sequence
  Synthetic
gacacccccauucuuuccuagga

SEQ ID NO: 6127 - RNA, 24 nt, Artificial Sequence
  Synthetic
gacaucccagguagagugugggga

SEQ ID NO: 6128 - RNA, 24 nt, Artificial Sequence
  Synthetic
gacccuacucucucuuuccugaua

SEQ ID NO: 6129 - RNA, 18 nt, Artificial Sequence
  Synthetic
gauuauggcgacugcacc

SEQ ID NO: 6130 - RNA, 20 nt, Artificial Sequence
  Synthetic
gcgauuauggcgacugcacc

SEQ ID NO: 6131 - RNA, 21 nt, Artificial Sequence
  Synthetic
ggcgauuauggcgacugcacc

SEQ ID NO: 6132 - RNA, 22 nt, Artificial Sequence
  Synthetic
gggcgauuauggcgacugcacc

SEQ ID NO: 6133 - RNA, 23 nt, Artificial Sequence
  Synthetic
ggggcgauuauggcgacugcacc

SEQ ID NO: 6134 - RNA, 24 nt, Artificial Sequence
  Synthetic
gggggcgauuauggcgacugcacc

SEQ ID NO: 6135 - RNA, 20 nt, Artificial Sequence
  Synthetic
gcagguuaguguccccuucc

SEQ ID NO: 6136 - RNA, 21 nt, Artificial Sequence
  Synthetic
gacuacagaaagcacaguucc

SEQ ID NO: 6137 - RNA, 23 nt, Artificial Sequence
  Synthetic
gugacuacagaaagcacaguucc

SEQ ID NO: 6138 - RNA, 24 nt, Artificial Sequence
  Synthetic
gaccuccaucagcaugaggaaggc

SEQ ID NO: 6139 - RNA, 18 nt, Artificial Sequence
  Synthetic
ggucuccugcaaccaggc

SEQ ID NO: 6140 - RNA, 19 nt, Artificial Sequence
  Synthetic
gucuccaggccgagggggc

SEQ ID NO: 6141 - RNA, 18 nt, Artificial Sequence
  Synthetic
guccacagugacuggggc

SEQ ID NO: 6142 - RNA, 21 nt, Artificial Sequence
  Synthetic
gcuguccacagugacuggggc

SEQ ID NO: 6143 - RNA, 22 nt, Artificial Sequence
  Synthetic
gcuucuaccagacauacucauc

SEQ ID NO: 6144 - RNA, 22 nt, Artificial Sequence
  Synthetic
gucccugaugcugcgcgcagag

SEQ ID NO: 6145 - RNA, 20 nt, Artificial Sequence
  Synthetic
gcccucggugacaucccagg

SEQ ID NO: 6146 - RNA, 21 nt, Artificial Sequence
  Synthetic
ggcccucggugacaucccagg

SEQ ID NO: 6147 - RNA, 24 nt, Artificial Sequence
  Synthetic
gauggcccucggugacaucccagg

SEQ ID NO: 6148 - RNA, 18 nt, Artificial Sequence
  Synthetic
guagaguguggggaaggg

SEQ ID NO: 6149 - RNA, 19 nt, Artificial Sequence
  Synthetic
gguagaguguggggaaggg

SEQ ID NO: 6150 - RNA, 21 nt, Artificial Sequence
  Synthetic
gcccggguaauggugcacggg

SEQ ID NO: 6151 - RNA, 22 nt, Artificial Sequence
  Synthetic
ggcccggguaauggugcacggg

SEQ ID NO: 6152 - RNA, 23 nt, Artificial Sequence
  Synthetic
gggcccggguaauggugcacggg

SEQ ID NO: 6153 - RNA, 24 nt, Artificial Sequence
  Synthetic
ggggcccggguaauggugcacggg

SEQ ID NO: 6154 - RNA, 18 nt, Artificial Sequence
  Synthetic
guggggaagggaugggug

SEQ ID NO: 6155 - RNA, 22 nt, Artificial Sequence
  Synthetic
gaguguggggaagggaugggug

SEQ ID NO: 6156 - RNA, 20 nt, Artificial Sequence
  Synthetic
gacaagaacaacuccaaccu

SEQ ID NO: 6157 - RNA, 18 nt, Artificial Sequence
  Synthetic
gcaccccuugcagcgccu

SEQ ID NO: 6158 - RNA, 21 nt, Artificial Sequence
  Synthetic
gccgcaccccuugcagcgccu

SEQ ID NO: 6159 - RNA, 19 nt, Artificial Sequence
  Synthetic
gacacccccauucuuuccu

SEQ ID NO: 6160 - RNA, 22 nt, Artificial Sequence
  Synthetic
gaugacacccccauucuuuccu

SEQ ID NO: 6161 - RNA, 20 nt, Artificial Sequence
  Synthetic
gcugaacuacaaaaccaauu

SEQ ID NO: 6162 - RNA, 22 nt, Artificial Sequence
  Synthetic
gagcugaacuacaaaaccaauu

SEQ ID NO: 6163 - RNA, 23 nt, Artificial Sequence
  Synthetic
ggagcugaacuacaaaaccaauu

SEQ ID NO: 6164 - RNA, 19 nt, Artificial Sequence
  Synthetic
gcaggaugaaccugccuuu

SEQ ID NO: 6165 - RNA, 20 nt, Artificial Sequence
  Synthetic
ggcaggaugaaccugccuuu

SEQ ID NO: 6166 - RNA, 21 nt, Artificial Sequence
  Synthetic
gggcaggaugaaccugccuuu

SEQ ID NO: 6167 - RNA, 18 nt, Artificial Sequence
  Synthetic
cugaaggggcgaggggaa

SEQ ID NO: 6168 - RNA, 19 nt, Artificial Sequence
  Synthetic
ccugaaggggcgaggggaa

SEQ ID NO: 6169 - RNA, 20 nt, Artificial Sequence
  Synthetic
accugaaggggcgaggggaa

SEQ ID NO: 6170 - RNA, 21 nt, Artificial Sequence
  Synthetic
uaccugaaggggcgaggggaa

SEQ ID NO: 6171 - RNA, 19 nt, Artificial Sequence
  Synthetic
ugggacaaggacagagaca

SEQ ID NO: 6172 - RNA, 23 nt, Artificial Sequence
  Synthetic
uggcugggacaaggacagagaca

SEQ ID NO: 6173 - RNA, 24 nt, Artificial Sequence
  Synthetic
cuggcugggacaaggacagagaca

SEQ ID NO: 6174 - RNA, 18 nt, Artificial Sequence
  Synthetic
uauagcaguuuccauaca

SEQ ID NO: 6175 - RNA, 20 nt, Artificial Sequence
  Synthetic
aguauagcaguuuccauaca

SEQ ID NO: 6176 - RNA, 21 nt, Artificial Sequence
  Synthetic
aaguauagcaguuuccauaca

SEQ ID NO: 6177 - RNA, 22 nt, Artificial Sequence
  Synthetic
aaaguauagcaguuuccauaca

SEQ ID NO: 6178 - RNA, 24 nt, Artificial Sequence
  Synthetic
ugaaaguauagcaguuuccauaca

SEQ ID NO: 6179 - RNA, 18 nt, Artificial Sequence
  Synthetic
uuucuuagguguggggca

SEQ ID NO: 6180 - RNA, 19 nt, Artificial Sequence
  Synthetic
auuucuuagguguggggca

SEQ ID NO: 6181 - RNA, 20 nt, Artificial Sequence
  Synthetic
cauuucuuagguguggggca

SEQ ID NO: 6182 - RNA, 21 nt, Artificial Sequence
  Synthetic
ccauuucuuagguguggggca

SEQ ID NO: 6183 - RNA, 22 nt, Artificial Sequence
  Synthetic
uccauuucuuagguguggggca

SEQ ID NO: 6184 - RNA, 23 nt, Artificial Sequence
  Synthetic
cuccauuucuuagguguggggca

SEQ ID NO: 6185 - RNA, 24 nt, Artificial Sequence
  Synthetic
acuccauuucuuagguguggggca

SEQ ID NO: 6186 - RNA, 18 nt, Artificial Sequence
  Synthetic
auuccuuaucaggaaaga

SEQ ID NO: 6187 - RNA, 19 nt, Artificial Sequence
  Synthetic
aauuccuuaucaggaaaga

SEQ ID NO: 6188 - RNA, 20 nt, Artificial Sequence
  Synthetic
uaauuccuuaucaggaaaga

SEQ ID NO: 6189 - RNA, 22 nt, Artificial Sequence
  Synthetic
aguaauuccuuaucaggaaaga

SEQ ID NO: 6190 - RNA, 24 nt, Artificial Sequence
  Synthetic
agaguaauuccuuaucaggaaaga

SEQ ID NO: 6191 - RNA, 18 nt, Artificial Sequence
  Synthetic
agucucuggcagccucga

SEQ ID NO: 6192 - RNA, 20 nt, Artificial Sequence
  Synthetic
agagucucuggcagccucga

SEQ ID NO: 6193 - RNA, 21 nt, Artificial Sequence
  Synthetic
cagagucucuggcagccucga

SEQ ID NO: 6194 - RNA, 24 nt, Artificial Sequence
  Synthetic
uggcagagucucuggcagccucga

SEQ ID NO: 6195 - RNA, 19 nt, Artificial Sequence
  Synthetic
ugcucuccuggaagcagga

SEQ ID NO: 6196 - RNA, 20 nt, Artificial Sequence
  Synthetic
augcucuccuggaagcagga

SEQ ID NO: 6197 - RNA, 21 nt, Artificial Sequence
  Synthetic
caugcucuccuggaagcagga

SEQ ID NO: 6198 - RNA, 22 nt, Artificial Sequence
  Synthetic
ucaugcucuccuggaagcagga

SEQ ID NO: 6199 - RNA, 23 nt, Artificial Sequence
  Synthetic
aucaugcucuccuggaagcagga

SEQ ID NO: 6200 - RNA, 20 nt, Artificial Sequence
  Synthetic
uggaagacccauuccuagga

SEQ ID NO: 6201 - RNA, 21 nt, Artificial Sequence
  Synthetic
cuggaagacccauuccuagga

SEQ ID NO: 6202 - RNA, 22 nt, Artificial Sequence
  Synthetic
ucuggaagacccauuccuagga

SEQ ID NO: 6203 - RNA, 23 nt, Artificial Sequence
  Synthetic
aucuggaagacccauuccuagga

SEQ ID NO: 6204 - RNA, 24 nt, Artificial Sequence
  Synthetic
caucuggaagacccauuccuagga

SEQ ID NO: 6205 - RNA, 20 nt, Artificial Sequence
  Synthetic
cggcugcgggagccggccac

SEQ ID NO: 6206 - RNA, 21 nt, Artificial Sequence
  Synthetic
acggcugcgggagccggccac

SEQ ID NO: 6207 - RNA, 23 nt, Artificial Sequence
  Synthetic
cgacggcugcgggagccggccac

SEQ ID NO: 6208 - RNA, 18 nt, Artificial Sequence
  Synthetic
ugcacuggacacagagac

SEQ ID NO: 6209 - RNA, 19 nt, Artificial Sequence
  Synthetic
uugcacuggacacagagac

SEQ ID NO: 6210 - RNA, 22 nt, Artificial Sequence
  Synthetic
ugguugcacuggacacagagac

SEQ ID NO: 6211 - RNA, 23 nt, Artificial Sequence
  Synthetic
cugguugcacuggacacagagac

SEQ ID NO: 6212 - RNA, 24 nt, Artificial Sequence
  Synthetic
ucugguugcacuggacacagagac

SEQ ID NO: 6213 - RNA, 18 nt, Artificial Sequence
  Synthetic
ccuuccccacacucuacc

SEQ ID NO: 6214 - RNA, 19 nt, Artificial Sequence
  Synthetic
cccuuccccacacucuacc

SEQ ID NO: 6215 - RNA, 21 nt, Artificial Sequence
  Synthetic
aucccuuccccacacucuacc

SEQ ID NO: 6216 - RNA, 22 nt, Artificial Sequence
  Synthetic
caucccuuccccacacucuacc

SEQ ID NO: 6217 - RNA, 23 nt, Artificial Sequence
  Synthetic
ccaucccuuccccacacucuacc

SEQ ID NO: 6218 - RNA, 24 nt, Artificial Sequence
  Synthetic
cccaucccuuccccacacucuacc

SEQ ID NO: 6219 - RNA, 18 nt, Artificial Sequence
  Synthetic
uggagaugggcgggggcc

SEQ ID NO: 6220 - RNA, 19 nt, Artificial Sequence
  Synthetic
cuggagaugggcgggggcc

SEQ ID NO: 6221 - RNA, 20 nt, Artificial Sequence
  Synthetic
ccuggagaugggcgggggcc

SEQ ID NO: 6222 - RNA, 21 nt, Artificial Sequence
  Synthetic
cccuggagaugggcgggggcc

SEQ ID NO: 6223 - RNA, 22 nt, Artificial Sequence
  Synthetic
ccccuggagaugggcgggggcc

SEQ ID NO: 6224 - RNA, 23 nt, Artificial Sequence
  Synthetic
cccccuggagaugggcgggggcc

SEQ ID NO: 6225 - RNA, 18 nt, Artificial Sequence
  Synthetic
acuccacguucuggggcc

SEQ ID NO: 6226 - RNA, 19 nt, Artificial Sequence
  Synthetic
uacuccacguucuggggcc

SEQ ID NO: 6227 - RNA, 21 nt, Artificial Sequence
  Synthetic
aguacuccacguucuggggcc

SEQ ID NO: 6228 - RNA, 22 nt, Artificial Sequence
  Synthetic
caguacuccacguucuggggcc

SEQ ID NO: 6229 - RNA, 23 nt, Artificial Sequence
  Synthetic
acaguacuccacguucuggggcc

SEQ ID NO: 6230 - RNA, 24 nt, Artificial Sequence
  Synthetic
cacaguacuccacguucuggggcc

SEQ ID NO: 6231 - RNA, 18 nt, Artificial Sequence
  Synthetic
cccagcguguccuccucc

SEQ ID NO: 6232 - RNA, 21 nt, Artificial Sequence
  Synthetic
uugcccagcguguccuccucc

SEQ ID NO: 6233 - RNA, 23 nt, Artificial Sequence
  Synthetic
aguugcccagcguguccuccucc

SEQ ID NO: 6234 - RNA, 24 nt, Artificial Sequence
  Synthetic
aaguugcccagcguguccuccucc

SEQ ID NO: 6235 - RNA, 18 nt, Artificial Sequence
  Synthetic
ucaugcucuccuggaagc

SEQ ID NO: 6236 - RNA, 19 nt, Artificial Sequence
  Synthetic
aucaugcucuccuggaagc

SEQ ID NO: 6237 - RNA, 21 nt, Artificial Sequence
  Synthetic
ugaucaugcucuccuggaagc

SEQ ID NO: 6238 - RNA, 22 nt, Artificial Sequence
  Synthetic
uugaucaugcucuccuggaagc

SEQ ID NO: 6239 - RNA, 23 nt, Artificial Sequence
  Synthetic
cuugaucaugcucuccuggaagc

SEQ ID NO: 6240 - RNA, 24 nt, Artificial Sequence
  Synthetic
ccuugaucaugcucuccuggaagc

SEQ ID NO: 6241 - RNA, 20 nt, Artificial Sequence
  Synthetic
ugggaaggaggggaggaugc

SEQ ID NO: 6242 - RNA, 22 nt, Artificial Sequence
  Synthetic
agugggaaggaggggaggaugc

SEQ ID NO: 6243 - RNA, 23 nt, Artificial Sequence
  Synthetic
aagugggaaggaggggaggaugc

SEQ ID NO: 6244 - RNA, 18 nt, Artificial Sequence
  Synthetic
augucaccgagggccauc

SEQ ID NO: 6245 - RNA, 22 nt, Artificial Sequence
  Synthetic
ugggaugucaccgagggccauc

SEQ ID NO: 6246 - RNA, 23 nt, Artificial Sequence
  Synthetic
cugggaugucaccgagggccauc

SEQ ID NO: 6247 - RNA, 24 nt, Artificial Sequence
  Synthetic
ccugggaugucaccgagggccauc

SEQ ID NO: 6248 - RNA, 18 nt, Artificial Sequence
  Synthetic
aucgcccccaagucuguc

SEQ ID NO: 6249 - RNA, 19 nt, Artificial Sequence
  Synthetic
aaucgcccccaagucuguc

SEQ ID NO: 6250 - RNA, 20 nt, Artificial Sequence
  Synthetic
uaaucgcccccaagucuguc

SEQ ID NO: 6251 - RNA, 21 nt, Artificial Sequence
  Synthetic
auaaucgcccccaagucuguc

SEQ ID NO: 6252 - RNA, 22 nt, Artificial Sequence
  Synthetic
cauaaucgcccccaagucuguc

SEQ ID NO: 6253 - RNA, 23 nt, Artificial Sequence
  Synthetic
ccauaaucgcccccaagucuguc

SEQ ID NO: 6254 - RNA, 20 nt, Artificial Sequence
  Synthetic
uggcugcccagguuggacag

SEQ ID NO: 6255 - RNA, 21 nt, Artificial Sequence
  Synthetic
cuggcugcccagguuggacag

SEQ ID NO: 6256 - RNA, 22 nt, Artificial Sequence
  Synthetic
acuggcugcccagguuggacag

SEQ ID NO: 6257 - RNA, 23 nt, Artificial Sequence
  Synthetic
cacuggcugcccagguuggacag

SEQ ID NO: 6258 - RNA, 24 nt, Artificial Sequence
  Synthetic
ccacuggcugcccagguuggacag

SEQ ID NO: 6259 - RNA, 18 nt, Artificial Sequence
  Synthetic
agucacuguggacagcag

SEQ ID NO: 6260 - RNA, 19 nt, Artificial Sequence
  Synthetic
cagucacuguggacagcag

SEQ ID NO: 6261 - RNA, 21 nt, Artificial Sequence
  Synthetic
cccagucacuguggacagcag

SEQ ID NO: 6262 - RNA, 22 nt, Artificial Sequence
  Synthetic
ccccagucacuguggacagcag

SEQ ID NO: 6263 - RNA, 18 nt, Artificial Sequence
  Synthetic
uuaucaggaaagagagag

SEQ ID NO: 6264 - RNA, 19 nt, Artificial Sequence
  Synthetic
cuuaucaggaaagagagag

SEQ ID NO: 6265 - RNA, 20 nt, Artificial Sequence
  Synthetic
ccuuaucaggaaagagagag

SEQ ID NO: 6266 - RNA, 21 nt, Artificial Sequence
  Synthetic
uccuuaucaggaaagagagag

SEQ ID NO: 6267 - RNA, 22 nt, Artificial Sequence
  Synthetic
uuccuuaucaggaaagagagag

SEQ ID NO: 6268 - RNA, 23 nt, Artificial Sequence
  Synthetic
auuccuuaucaggaaagagagag

SEQ ID NO: 6269 - RNA, 24 nt, Artificial Sequence
  Synthetic
aauuccuuaucaggaaagagagag

SEQ ID NO: 6270 - RNA, 18 nt, Artificial Sequence
  Synthetic
cuaggggugcagagagag

SEQ ID NO: 6271 - RNA, 19 nt, Artificial Sequence
  Synthetic
ccuaggggugcagagagag

SEQ ID NO: 6272 - RNA, 20 nt, Artificial Sequence
  Synthetic
accuaggggugcagagagag

SEQ ID NO: 6273 - RNA, 22 nt, Artificial Sequence
  Synthetic
agaccuaggggugcagagagag

SEQ ID NO: 6274 - RNA, 23 nt, Artificial Sequence
  Synthetic
cagaccuaggggugcagagagag

SEQ ID NO: 6275 - RNA, 24 nt, Artificial Sequence
  Synthetic
acagaccuaggggugcagagagag

SEQ ID NO: 6276 - RNA, 18 nt, Artificial Sequence
  Synthetic
uacacaccuggaagggag

SEQ ID NO: 6277 - RNA, 19 nt, Artificial Sequence
  Synthetic
auacacaccuggaagggag

SEQ ID NO: 6278 - RNA, 20 nt, Artificial Sequence
  Synthetic
aauacacaccuggaagggag

SEQ ID NO: 6279 - RNA, 22 nt, Artificial Sequence
  Synthetic
ugaauacacaccuggaagggag

SEQ ID NO: 6280 - RNA, 24 nt, Artificial Sequence
  Synthetic
agugaauacacaccuggaagggag

SEQ ID NO: 6281 - RNA, 20 nt, Artificial Sequence
  Synthetic
aggcgcugcaaggggugcgg

SEQ ID NO: 6282 - RNA, 21 nt, Artificial Sequence
  Synthetic
caggcgcugcaaggggugcgg

SEQ ID NO: 6283 - RNA, 22 nt, Artificial Sequence
  Synthetic
ucaggcgcugcaaggggugcgg

SEQ ID NO: 6284 - RNA, 23 nt, Artificial Sequence
  Synthetic
cucaggcgcugcaaggggugcgg

SEQ ID NO: 6285 - RNA, 24 nt, Artificial Sequence
  Synthetic
ccucaggcgcugcaaggggugcgg

SEQ ID NO: 6286 - RNA, 18 nt, Artificial Sequence
  Synthetic
cagaagugggaaggaggg

SEQ ID NO: 6287 - RNA, 24 nt, Artificial Sequence
  Synthetic
ugggggcagaagugggaaggaggg

SEQ ID NO: 6288 - RNA, 19 nt, Artificial Sequence
  Synthetic
uguccuccuccagggaugg

SEQ ID NO: 6289 - RNA, 21 nt, Artificial Sequence
  Synthetic
cguguccuccuccagggaugg

SEQ ID NO: 6290 - RNA, 23 nt, Artificial Sequence
  Synthetic
agcguguccuccuccagggaugg

SEQ ID NO: 6291 - RNA, 24 nt, Artificial Sequence
  Synthetic
cagcguguccuccuccagggaugg

SEQ ID NO: 6292 - RNA, 18 nt, Artificial Sequence
  Synthetic
ucaccgcauccaccccug

SEQ ID NO: 6293 - RNA, 19 nt, Artificial Sequence
  Synthetic
cucaccgcauccaccccug

SEQ ID NO: 6294 - RNA, 20 nt, Artificial Sequence
  Synthetic
ccucaccgcauccaccccug

SEQ ID NO: 6295 - RNA, 21 nt, Artificial Sequence
  Synthetic
cccucaccgcauccaccccug

SEQ ID NO: 6296 - RNA, 22 nt, Artificial Sequence
  Synthetic
ucccucaccgcauccaccccug

SEQ ID NO: 6297 - RNA, 23 nt, Artificial Sequence
  Synthetic
cucccucaccgcauccaccccug

SEQ ID NO: 6298 - RNA, 24 nt, Artificial Sequence
  Synthetic
acucccucaccgcauccaccccug

SEQ ID NO: 6299 - RNA, 18 nt, Artificial Sequence
  Synthetic
ccugcuguguguacuuug

SEQ ID NO: 6300 - RNA, 19 nt, Artificial Sequence
  Synthetic
accugcuguguguacuuug

SEQ ID NO: 6301 - RNA, 20 nt, Artificial Sequence
  Synthetic
caccugcuguguguacuuug

SEQ ID NO: 6302 - RNA, 21 nt, Artificial Sequence
  Synthetic
ucaccugcuguguguacuuug

SEQ ID NO: 6303 - RNA, 22 nt, Artificial Sequence
  Synthetic
cucaccugcuguguguacuuug

SEQ ID NO: 6304 - RNA, 23 nt, Artificial Sequence
  Synthetic
ccucaccugcuguguguacuuug

SEQ ID NO: 6305 - RNA, 18 nt, Artificial Sequence
  Synthetic
ccauuccuaggaaagaau

SEQ ID NO: 6306 - RNA, 19 nt, Artificial Sequence
  Synthetic
cccauuccuaggaaagaau

SEQ ID NO: 6307 - RNA, 22 nt, Artificial Sequence
  Synthetic
agacccauuccuaggaaagaau

SEQ ID NO: 6308 - RNA, 23 nt, Artificial Sequence
  Synthetic
aagacccauuccuaggaaagaau

SEQ ID NO: 6309 - RNA, 18 nt, Artificial Sequence
  Synthetic
ccgugacagagggagacu

SEQ ID NO: 6310 - RNA, 19 nt, Artificial Sequence
  Synthetic
accgugacagagggagacu

SEQ ID NO: 6311 - RNA, 20 nt, Artificial Sequence
  Synthetic
uaccgugacagagggagacu

SEQ ID NO: 6312 - RNA, 21 nt, Artificial Sequence
  Synthetic
cuaccgugacagagggagacu

SEQ ID NO: 6313 - RNA, 22 nt, Artificial Sequence
  Synthetic
ccuaccgugacagagggagacu

SEQ ID NO: 6314 - RNA, 23 nt, Artificial Sequence
  Synthetic
accuaccgugacagagggagacu

SEQ ID NO: 6315 - RNA, 18 nt, Artificial Sequence
  Synthetic
aguccuuccaguccaccu

SEQ ID NO: 6316 - RNA, 19 nt, Artificial Sequence
  Synthetic
caguccuuccaguccaccu

SEQ ID NO: 6317 - RNA, 21 nt, Artificial Sequence
  Synthetic
uccaguccuuccaguccaccu

SEQ ID NO: 6318 - RNA, 22 nt, Artificial Sequence
  Synthetic
uuccaguccuuccaguccaccu

SEQ ID NO: 6319 - RNA, 23 nt, Artificial Sequence
  Synthetic
cuuccaguccuuccaguccaccu

SEQ ID NO: 6320 - RNA, 24 nt, Artificial Sequence
  Synthetic
ucuuccaguccuuccaguccaccu

SEQ ID NO: 6321 - RNA, 18 nt, Artificial Sequence
  Synthetic
agcaucagggacagaccu

SEQ ID NO: 6322 - RNA, 19 nt, Artificial Sequence
  Synthetic
cagcaucagggacagaccu

SEQ ID NO: 6323 - RNA, 21 nt, Artificial Sequence
  Synthetic
cgcagcaucagggacagaccu

SEQ ID NO: 6324 - RNA, 23 nt, Artificial Sequence
  Synthetic
cgcgcagcaucagggacagaccu

SEQ ID NO: 6325 - RNA, 18 nt, Artificial Sequence
  Synthetic
uuauaguagcaguacccu

SEQ ID NO: 6326 - RNA, 19 nt, Artificial Sequence
  Synthetic
cuuauaguagcaguacccu

SEQ ID NO: 6327 - RNA, 21 nt, Artificial Sequence
  Synthetic
agcuuauaguagcaguacccu

SEQ ID NO: 6328 - RNA, 24 nt, Artificial Sequence
  Synthetic
uggagcuuauaguagcaguacccu

SEQ ID NO: 6329 - RNA, 18 nt, Artificial Sequence
  Synthetic
cugguagcuggucacgcu

SEQ ID NO: 6330 - RNA, 22 nt, Artificial Sequence
  Synthetic
agagcugguagcuggucacgcu

SEQ ID NO: 6331 - RNA, 24 nt, Artificial Sequence
  Synthetic
agagagcugguagcuggucacgcu

SEQ ID NO: 6332 - RNA, 18 nt, Artificial Sequence
  Synthetic
acaucgggugguggaagu

SEQ ID NO: 6333 - RNA, 19 nt, Artificial Sequence
  Synthetic
uacaucgggugguggaagu

SEQ ID NO: 6334 - RNA, 20 nt, Artificial Sequence
  Synthetic
auacaucgggugguggaagu

SEQ ID NO: 6335 - RNA, 21 nt, Artificial Sequence
  Synthetic
cauacaucgggugguggaagu

SEQ ID NO: 6336 - RNA, 22 nt, Artificial Sequence
  Synthetic
ccauacaucgggugguggaagu

SEQ ID NO: 6337 - RNA, 23 nt, Artificial Sequence
  Synthetic
uccauacaucgggugguggaagu

SEQ ID NO: 6338 - RNA, 24 nt, Artificial Sequence
  Synthetic
uuccauacaucgggugguggaagu

SEQ ID NO: 6339 - RNA, 18 nt, Artificial Sequence
  Synthetic
uggaagacauccagaggu

SEQ ID NO: 6340 - RNA, 19 nt, Artificial Sequence
  Synthetic
auggaagacauccagaggu

SEQ ID NO: 6341 - RNA, 23 nt, Artificial Sequence
  Synthetic
aggcauggaagacauccagaggu

SEQ ID NO: 6342 - RNA, 24 nt, Artificial Sequence
  Synthetic
caggcauggaagacauccagaggu

SEQ ID NO: 6343 - RNA, 18 nt, Artificial Sequence
  Synthetic
ccagcuccucuuuaauuu

SEQ ID NO: 6344 - RNA, 19 nt, Artificial Sequence
  Synthetic
uccagcuccucuuuaauuu

SEQ ID NO: 6345 - RNA, 20 nt, Artificial Sequence
  Synthetic
cuccagcuccucuuuaauuu

SEQ ID NO: 6346 - RNA, 21 nt, Artificial Sequence
  Synthetic
ccuccagcuccucuuuaauuu

SEQ ID NO: 6347 - RNA, 22 nt, Artificial Sequence
  Synthetic
uccuccagcuccucuuuaauuu

SEQ ID NO: 6348 - RNA, 23 nt, Artificial Sequence
  Synthetic
cuccuccagcuccucuuuaauuu

SEQ ID NO: 6349 - RNA, 18 nt, Artificial Sequence
  Synthetic
ugccccacaccuaagaaa

SEQ ID NO: 6350 - RNA, 19 nt, Artificial Sequence
  Synthetic
cugccccacaccuaagaaa

SEQ ID NO: 6351 - RNA, 21 nt, Artificial Sequence
  Synthetic
cucugccccacaccuaagaaa

SEQ ID NO: 6352 - RNA, 22 nt, Artificial Sequence
  Synthetic
ccucugccccacaccuaagaaa

SEQ ID NO: 6353 - RNA, 23 nt, Artificial Sequence
  Synthetic
cccucugccccacaccuaagaaa

SEQ ID NO: 6354 - RNA, 24 nt, Artificial Sequence
  Synthetic
acccucugccccacaccuaagaaa

SEQ ID NO: 6355 - RNA, 19 nt, Artificial Sequence
  Synthetic
aggcaucucucuguaccca

SEQ ID NO: 6356 - RNA, 20 nt, Artificial Sequence
  Synthetic
caggcaucucucuguaccca

SEQ ID NO: 6357 - RNA, 21 nt, Artificial Sequence
  Synthetic
acaggcaucucucuguaccca

SEQ ID NO: 6358 - RNA, 22 nt, Artificial Sequence
  Synthetic
aacaggcaucucucuguaccca

SEQ ID NO: 6359 - RNA, 24 nt, Artificial Sequence
  Synthetic
agaacaggcaucucucuguaccca

SEQ ID NO: 6360 - RNA, 18 nt, Artificial Sequence
  Synthetic
uccaggagagcaugauca

SEQ ID NO: 6361 - RNA, 19 nt, Artificial Sequence
  Synthetic
uuccaggagagcaugauca

SEQ ID NO: 6362 - RNA, 22 nt, Artificial Sequence
  Synthetic
ugcuuccaggagagcaugauca

SEQ ID NO: 6363 - RNA, 23 nt, Artificial Sequence
  Synthetic
cugcuuccaggagagcaugauca

SEQ ID NO: 6364 - RNA, 24 nt, Artificial Sequence
  Synthetic
ccugcuuccaggagagcaugauca

SEQ ID NO: 6365 - RNA, 18 nt, Artificial Sequence
  Synthetic
ccccauucuuuccuagga

SEQ ID NO: 6366 - RNA, 19 nt, Artificial Sequence
  Synthetic
cccccauucuuuccuagga

SEQ ID NO: 6367 - RNA, 20 nt, Artificial Sequence
  Synthetic
acccccauucuuuccuagga

SEQ ID NO: 6368 - RNA, 21 nt, Artificial Sequence
  Synthetic
cacccccauucuuuccuagga

SEQ ID NO: 6369 - RNA, 22 nt, Artificial Sequence
  Synthetic
acacccccauucuuuccuagga

SEQ ID NO: 6370 - RNA, 24 nt, Artificial Sequence
  Synthetic
ugacacccccauucuuuccuagga

SEQ ID NO: 6371 - RNA, 18 nt, Artificial Sequence
  Synthetic
ccagguagagugugggga

SEQ ID NO: 6372 - RNA, 19 nt, Artificial Sequence
  Synthetic
cccagguagagugugggga

SEQ ID NO: 6373 - RNA, 21 nt, Artificial Sequence
  Synthetic
aucccagguagagugugggga

SEQ ID NO: 6374 - RNA, 22 nt, Artificial Sequence
  Synthetic
caucccagguagagugugggga

SEQ ID NO: 6375 - RNA, 23 nt, Artificial Sequence
  Synthetic
acaucccagguagagugugggga

SEQ ID NO: 6376 - RNA, 18 nt, Artificial Sequence
  Synthetic
cagggguggaugcgguga

SEQ ID NO: 6377 - RNA, 19 nt, Artificial Sequence
  Synthetic
ucagggguggaugcgguga

SEQ ID NO: 6378 - RNA, 21 nt, Artificial Sequence
  Synthetic
caucagggguggaugcgguga

SEQ ID NO: 6379 - RNA, 22 nt, Artificial Sequence
  Synthetic
ucaucagggguggaugcgguga

SEQ ID NO: 6380 - RNA, 23 nt, Artificial Sequence
  Synthetic
cucaucagggguggaugcgguga

SEQ ID NO: 6381 - RNA, 24 nt, Artificial Sequence
  Synthetic
acucaucagggguggaugcgguga

SEQ ID NO: 6382 - RNA, 18 nt, Artificial Sequence
  Synthetic
acucucucuuuccugaua

SEQ ID NO: 6383 - RNA, 19 nt, Artificial Sequence
  Synthetic
uacucucucuuuccugaua

SEQ ID NO: 6384 - RNA, 21 nt, Artificial Sequence
  Synthetic
ccuacucucucuuuccugaua

SEQ ID NO: 6385 - RNA, 22 nt, Artificial Sequence
  Synthetic
cccuacucucucuuuccugaua

SEQ ID NO: 6386 - RNA, 23 nt, Artificial Sequence
  Synthetic
acccuacucucucuuuccugaua

SEQ ID NO: 6387 - RNA, 19 nt, Artificial Sequence
  Synthetic
cgauuauggcgacugcacc

SEQ ID NO: 6388 - RNA, 18 nt, Artificial Sequence
  Synthetic
cuggaugucuuccaugcc

SEQ ID NO: 6389 - RNA, 19 nt, Artificial Sequence
  Synthetic
ucuggaugucuuccaugcc

SEQ ID NO: 6390 - RNA, 21 nt, Artificial Sequence
  Synthetic
ccucuggaugucuuccaugcc

SEQ ID NO: 6391 - RNA, 22 nt, Artificial Sequence
  Synthetic
accucuggaugucuuccaugcc

SEQ ID NO: 6392 - RNA, 23 nt, Artificial Sequence
  Synthetic
aaccucuggaugucuuccaugcc

SEQ ID NO: 6393 - RNA, 24 nt, Artificial Sequence
  Synthetic
caaccucuggaugucuuccaugcc

SEQ ID NO: 6394 - RNA, 18 nt, Artificial Sequence
  Synthetic
agguuaguguccccuucc

SEQ ID NO: 6395 - RNA, 19 nt, Artificial Sequence
  Synthetic
cagguuaguguccccuucc

SEQ ID NO: 6396 - RNA, 21 nt, Artificial Sequence
  Synthetic
ugcagguuaguguccccuucc

SEQ ID NO: 6397 - RNA, 22 nt, Artificial Sequence
  Synthetic
augcagguuaguguccccuucc

SEQ ID NO: 6398 - RNA, 23 nt, Artificial Sequence
  Synthetic
caugcagguuaguguccccuucc

SEQ ID NO: 6399 - RNA, 24 nt, Artificial Sequence
  Synthetic
ccaugcagguuaguguccccuucc

SEQ ID NO: 6400 - RNA, 18 nt, Artificial Sequence
  Synthetic
uacagaaagcacaguucc

SEQ ID NO: 6401 - RNA, 19 nt, Artificial Sequence
  Synthetic
cuacagaaagcacaguucc

SEQ ID NO: 6402 - RNA, 22 nt, Artificial Sequence
  Synthetic
ugacuacagaaagcacaguucc

SEQ ID NO: 6403 - RNA, 24 nt, Artificial Sequence
  Synthetic
ugugacuacagaaagcacaguucc

SEQ ID NO: 6404 - RNA, 18 nt, Artificial Sequence
  Synthetic
caucagcaugaggaaggc

SEQ ID NO: 6405 - RNA, 19 nt, Artificial Sequence
  Synthetic
ccaucagcaugaggaaggc

SEQ ID NO: 6406 - RNA, 20 nt, Artificial Sequence
  Synthetic
uccaucagcaugaggaaggc

SEQ ID NO: 6407 - RNA, 21 nt, Artificial Sequence
  Synthetic
cuccaucagcaugaggaaggc

SEQ ID NO: 6408 - RNA, 22 nt, Artificial Sequence
  Synthetic
ccuccaucagcaugaggaaggc

SEQ ID NO: 6409 - RNA, 23 nt, Artificial Sequence
  Synthetic
accuccaucagcaugaggaaggc

SEQ ID NO: 6410 - RNA, 19 nt, Artificial Sequence
  Synthetic
aggucuccugcaaccaggc

SEQ ID NO: 6411 - RNA, 20 nt, Artificial Sequence
  Synthetic
caggucuccugcaaccaggc

SEQ ID NO: 6412 - RNA, 21 nt, Artificial Sequence
  Synthetic
ccaggucuccugcaaccaggc

SEQ ID NO: 6413 - RNA, 22 nt, Artificial Sequence
  Synthetic
accaggucuccugcaaccaggc

SEQ ID NO: 6414 - RNA, 23 nt, Artificial Sequence
  Synthetic
aaccaggucuccugcaaccaggc

SEQ ID NO: 6415 - RNA, 24 nt, Artificial Sequence
  Synthetic
caaccaggucuccugcaaccaggc

SEQ ID NO: 6416 - RNA, 18 nt, Artificial Sequence
  Synthetic
ucuccaggccgagggggc

SEQ ID NO: 6417 - RNA, 21 nt, Artificial Sequence
  Synthetic
uggucuccaggccgagggggc

SEQ ID NO: 6418 - RNA, 22 nt, Artificial Sequence
  Synthetic
cuggucuccaggccgagggggc

SEQ ID NO: 6419 - RNA, 23 nt, Artificial Sequence
  Synthetic
acuggucuccaggccgagggggc

SEQ ID NO: 6420 - RNA, 24 nt, Artificial Sequence
  Synthetic
uacuggucuccaggccgagggggc

SEQ ID NO: 6421 - RNA, 19 nt, Artificial Sequence
  Synthetic
uguccacagugacuggggc

SEQ ID NO: 6422 - RNA, 20 nt, Artificial Sequence
  Synthetic
cuguccacagugacuggggc

SEQ ID NO: 6423 - RNA, 22 nt, Artificial Sequence
  Synthetic
ugcuguccacagugacuggggc

SEQ ID NO: 6424 - RNA, 23 nt, Artificial Sequence
  Synthetic
cugcuguccacagugacuggggc

SEQ ID NO: 6425 - RNA, 24 nt, Artificial Sequence
  Synthetic
ccugcuguccacagugacuggggc

SEQ ID NO: 6426 - RNA, 18 nt, Artificial Sequence
  Synthetic
ugucacgguaggucgugc

SEQ ID NO: 6427 - RNA, 19 nt, Artificial Sequence
  Synthetic
cugucacgguaggucgugc

SEQ ID NO: 6428 - RNA, 20 nt, Artificial Sequence
  Synthetic
ucugucacgguaggucgugc

SEQ ID NO: 6429 - RNA, 21 nt, Artificial Sequence
  Synthetic
cucugucacgguaggucgugc

SEQ ID NO: 6430 - RNA, 22 nt, Artificial Sequence
  Synthetic
ccucugucacgguaggucgugc

SEQ ID NO: 6431 - RNA, 23 nt, Artificial Sequence
  Synthetic
cccucugucacgguaggucgugc

SEQ ID NO: 6432 - RNA, 24 nt, Artificial Sequence
  Synthetic
ucccucugucacgguaggucgugc

SEQ ID NO: 6433 - RNA, 18 nt, Artificial Sequence
  Synthetic
cuaccagacauacucauc

SEQ ID NO: 6434 - RNA, 19 nt, Artificial Sequence
  Synthetic
ucuaccagacauacucauc

SEQ ID NO: 6435 - RNA, 21 nt, Artificial Sequence
  Synthetic
cuucuaccagacauacucauc

SEQ ID NO: 6436 - RNA, 23 nt, Artificial Sequence
  Synthetic
ugcuucuaccagacauacucauc

SEQ ID NO: 6437 - RNA, 24 nt, Artificial Sequence
  Synthetic
cugcuucuaccagacauacucauc

SEQ ID NO: 6438 - RNA, 18 nt, Artificial Sequence
  Synthetic
cugaugcugcgcgcagag

SEQ ID NO: 6439 - RNA, 19 nt, Artificial Sequence
  Synthetic
ccugaugcugcgcgcagag

SEQ ID NO: 6440 - RNA, 20 nt, Artificial Sequence
  Synthetic
cccugaugcugcgcgcagag

SEQ ID NO: 6441 - RNA, 21 nt, Artificial Sequence
  Synthetic
ucccugaugcugcgcgcagag

SEQ ID NO: 6442 - RNA, 23 nt, Artificial Sequence
  Synthetic
ugucccugaugcugcgcgcagag

SEQ ID NO: 6443 - RNA, 24 nt, Artificial Sequence
  Synthetic
cugucccugaugcugcgcgcagag

SEQ ID NO: 6444 - RNA, 18 nt, Artificial Sequence
  Synthetic
auccgcggccccagaacg

SEQ ID NO: 6445 - RNA, 19 nt, Artificial Sequence
  Synthetic
uauccgcggccccagaacg

SEQ ID NO: 6446 - RNA, 21 nt, Artificial Sequence
  Synthetic
ucuauccgcggccccagaacg

SEQ ID NO: 6447 - RNA, 22 nt, Artificial Sequence
  Synthetic
uucuauccgcggccccagaacg

SEQ ID NO: 6448 - RNA, 23 nt, Artificial Sequence
  Synthetic
cuucuauccgcggccccagaacg

SEQ ID NO: 6449 - RNA, 24 nt, Artificial Sequence
  Synthetic
ucuucuauccgcggccccagaacg

SEQ ID NO: 6450 - RNA, 18 nt, Artificial Sequence
  Synthetic
ccucggugacaucccagg

SEQ ID NO: 6451 - RNA, 19 nt, Artificial Sequence
  Synthetic
cccucggugacaucccagg

SEQ ID NO: 6452 - RNA, 22 nt, Artificial Sequence
  Synthetic
uggcccucggugacaucccagg

SEQ ID NO: 6453 - RNA, 23 nt, Artificial Sequence
  Synthetic
auggcccucggugacaucccagg

SEQ ID NO: 6454 - RNA, 20 nt, Artificial Sequence
  Synthetic
agguagaguguggggaaggg

SEQ ID NO: 6455 - RNA, 21 nt, Artificial Sequence
  Synthetic
cagguagaguguggggaaggg

SEQ ID NO: 6456 - RNA, 22 nt, Artificial Sequence
  Synthetic
ccagguagaguguggggaaggg

SEQ ID NO: 6457 - RNA, 23 nt, Artificial Sequence
  Synthetic
cccagguagaguguggggaaggg

SEQ ID NO: 6458 - RNA, 24 nt, Artificial Sequence
  Synthetic
ucccagguagaguguggggaaggg

SEQ ID NO: 6459 - RNA, 18 nt, Artificial Sequence
  Synthetic
cagacauacucaucaggg

SEQ ID NO: 6460 - RNA, 19 nt, Artificial Sequence
  Synthetic
ccagacauacucaucaggg

SEQ ID NO: 6461 - RNA, 20 nt, Artificial Sequence
  Synthetic
accagacauacucaucaggg

SEQ ID NO: 6462 - RNA, 21 nt, Artificial Sequence
  Synthetic
uaccagacauacucaucaggg

SEQ ID NO: 6463 - RNA, 22 nt, Artificial Sequence
  Synthetic
cuaccagacauacucaucaggg

SEQ ID NO: 6464 - RNA, 23 nt, Artificial Sequence
  Synthetic
ucuaccagacauacucaucaggg

SEQ ID NO: 6465 - RNA, 24 nt, Artificial Sequence
  Synthetic
uucuaccagacauacucaucaggg

SEQ ID NO: 6466 - RNA, 18 nt, Artificial Sequence
  Synthetic
cggguaauggugcacggg

SEQ ID NO: 6467 - RNA, 19 nt, Artificial Sequence
  Synthetic
ccggguaauggugcacggg

SEQ ID NO: 6468 - RNA, 20 nt, Artificial Sequence
  Synthetic
cccggguaauggugcacggg

SEQ ID NO: 6469 - RNA, 19 nt, Artificial Sequence
  Synthetic
uguggggaagggaugggug

SEQ ID NO: 6470 - RNA, 21 nt, Artificial Sequence
  Synthetic
aguguggggaagggaugggug

SEQ ID NO: 6471 - RNA, 23 nt, Artificial Sequence
  Synthetic
agaguguggggaagggaugggug

SEQ ID NO: 6472 - RNA, 24 nt, Artificial Sequence
  Synthetic
uagaguguggggaagggaugggug

SEQ ID NO: 6473 - RNA, 18 nt, Artificial Sequence
  Synthetic
caagaacaacuccaaccu

SEQ ID NO: 6474 - RNA, 19 nt, Artificial Sequence
  Synthetic
acaagaacaacuccaaccu

SEQ ID NO: 6475 - RNA, 21 nt, Artificial Sequence
  Synthetic
ugacaagaacaacuccaaccu

SEQ ID NO: 6476 - RNA, 22 nt, Artificial Sequence
  Synthetic
augacaagaacaacuccaaccu

SEQ ID NO: 6477 - RNA, 23 nt, Artificial Sequence
  Synthetic
aaugacaagaacaacuccaaccu

SEQ ID NO: 6478 - RNA, 24 nt, Artificial Sequence
  Synthetic
caaugacaagaacaacuccaaccu

SEQ ID NO: 6479 - RNA, 19 nt, Artificial Sequence
  Synthetic
cgcaccccuugcagcgccu

SEQ ID NO: 6480 - RNA, 20 nt, Artificial Sequence
  Synthetic
ccgcaccccuugcagcgccu

SEQ ID NO: 6481 - RNA, 22 nt, Artificial Sequence
  Synthetic
ugccgcaccccuugcagcgccu

SEQ ID NO: 6482 - RNA, 23 nt, Artificial Sequence
  Synthetic
cugccgcaccccuugcagcgccu

SEQ ID NO: 6483 - RNA, 24 nt, Artificial Sequence
  Synthetic
ucugccgcaccccuugcagcgccu

SEQ ID NO: 6484 - RNA, 18 nt, Artificial Sequence
  Synthetic
acacccccauucuuuccu

SEQ ID NO: 6485 - RNA, 21 nt, Artificial Sequence
  Synthetic
augacacccccauucuuuccu

SEQ ID NO: 6486 - RNA, 23 nt, Artificial Sequence
  Synthetic
ugaugacacccccauucuuuccu

SEQ ID NO: 6487 - RNA, 24 nt, Artificial Sequence
  Synthetic
uugaugacacccccauucuuuccu

SEQ ID NO: 6488 - RNA, 18 nt, Artificial Sequence
  Synthetic
ugaacuacaaaaccaauu

SEQ ID NO: 6489 - RNA, 19 nt, Artificial Sequence
  Synthetic
cugaacuacaaaaccaauu

SEQ ID NO: 6490 - RNA, 21 nt, Artificial Sequence
  Synthetic
agcugaacuacaaaaccaauu

SEQ ID NO: 6491 - RNA, 24 nt, Artificial Sequence
  Synthetic
aggagcugaacuacaaaaccaauu

SEQ ID NO: 6492 - RNA, 18 nt, Artificial Sequence
  Synthetic
caggaugaaccugccuuu

SEQ ID NO: 6493 - RNA, 22 nt, Artificial Sequence
  Synthetic
cgggcaggaugaaccugccuuu

SEQ ID NO: 6494 - RNA, 23 nt, Artificial Sequence
  Synthetic
acgggcaggaugaaccugccuuu

SEQ ID NO: 6495 - RNA, 24 nt, Artificial Sequence
  Synthetic
cacgggcaggaugaaccugccuuu

SEQ ID NO: 6496 - RNA, 18 nt, Artificial Sequence
  Synthetic
uaauuccuuaucaggaaa

SEQ ID NO: 6497 - RNA, 19 nt, Artificial Sequence
  Synthetic
guaauuccuuaucaggaaa

SEQ ID NO: 6498 - RNA, 20 nt, Artificial Sequence
  Synthetic
aguaauuccuuaucaggaaa

SEQ ID NO: 6499 - RNA, 21 nt, Artificial Sequence
  Synthetic
gaguaauuccuuaucaggaaa

SEQ ID NO: 6500 - RNA, 22 nt, Artificial Sequence
  Synthetic
agaguaauuccuuaucaggaaa

SEQ ID NO: 6501 - RNA, 23 nt, Artificial Sequence
  Synthetic
gagaguaauuccuuaucaggaaa

SEQ ID NO: 6502 - RNA, 24 nt, Artificial Sequence
  Synthetic
ugagaguaauuccuuaucaggaaa

SEQ ID NO: 6503 - RNA, 18 nt, Artificial Sequence
  Synthetic
aaggguaaagguucucaa

SEQ ID NO: 6504 - RNA, 19 nt, Artificial Sequence
  Synthetic
gaaggguaaagguucucaa

SEQ ID NO: 6505 - RNA, 20 nt, Artificial Sequence
  Synthetic
ugaaggguaaagguucucaa

SEQ ID NO: 6506 - RNA, 21 nt, Artificial Sequence
  Synthetic
uugaaggguaaagguucucaa

SEQ ID NO: 6507 - RNA, 22 nt, Artificial Sequence
  Synthetic
uuugaaggguaaagguucucaa

SEQ ID NO: 6508 - RNA, 23 nt, Artificial Sequence
  Synthetic
cuuugaaggguaaagguucucaa

SEQ ID NO: 6509 - RNA, 24 nt, Artificial Sequence
  Synthetic
acuuugaaggguaaagguucucaa

SEQ ID NO: 6510 - RNA, 18 nt, Artificial Sequence
  Synthetic
cccauuccuaggaaagaa

SEQ ID NO: 6511 - RNA, 19 nt, Artificial Sequence
  Synthetic
acccauuccuaggaaagaa

SEQ ID NO: 6512 - RNA, 21 nt, Artificial Sequence
  Synthetic
agacccauuccuaggaaagaa

SEQ ID NO: 6513 - RNA, 22 nt, Artificial Sequence
  Synthetic
aagacccauuccuaggaaagaa

SEQ ID NO: 6514 - RNA, 23 nt, Artificial Sequence
  Synthetic
gaagacccauuccuaggaaagaa

SEQ ID NO: 6515 - RNA, 24 nt, Artificial Sequence
  Synthetic
ggaagacccauuccuaggaaagaa

SEQ ID NO: 6516 - RNA, 18 nt, Artificial Sequence
  Synthetic
cauggggugggggcagaa

SEQ ID NO: 6517 - RNA, 19 nt, Artificial Sequence
  Synthetic
acauggggugggggcagaa

SEQ ID NO: 6518 - RNA, 20 nt, Artificial Sequence
  Synthetic
gacauggggugggggcagaa

SEQ ID NO: 6519 - RNA, 21 nt, Artificial Sequence
  Synthetic
agacauggggugggggcagaa

SEQ ID NO: 6520 - RNA, 22 nt, Artificial Sequence
  Synthetic
gagacauggggugggggcagaa

SEQ ID NO: 6521 - RNA, 23 nt, Artificial Sequence
  Synthetic
agagacauggggugggggcagaa

SEQ ID NO: 6522 - RNA, 24 nt, Artificial Sequence
  Synthetic
cagagacauggggugggggcagaa

SEQ ID NO: 6523 - RNA, 18 nt, Artificial Sequence
  Synthetic
gugaauacacaccuggaa

SEQ ID NO: 6524 - RNA, 19 nt, Artificial Sequence
  Synthetic
agugaauacacaccuggaa

SEQ ID NO: 6525 - RNA, 21 nt, Artificial Sequence
  Synthetic
ggagugaauacacaccuggaa

SEQ ID NO: 6526 - RNA, 22 nt, Artificial Sequence
  Synthetic
aggagugaauacacaccuggaa

SEQ ID NO: 6527 - RNA, 23 nt, Artificial Sequence
  Synthetic
caggagugaauacacaccuggaa

SEQ ID NO: 6528 - RNA, 24 nt, Artificial Sequence
  Synthetic
gcaggagugaauacacaccuggaa

SEQ ID NO: 6529 - RNA, 18 nt, Artificial Sequence
  Synthetic
auacaucgggugguggaa

SEQ ID NO: 6530 - RNA, 19 nt, Artificial Sequence
  Synthetic
cauacaucgggugguggaa

SEQ ID NO: 6531 - RNA, 20 nt, Artificial Sequence
  Synthetic
ccauacaucgggugguggaa

SEQ ID NO: 6532 - RNA, 21 nt, Artificial Sequence
  Synthetic
uccauacaucgggugguggaa

SEQ ID NO: 6533 - RNA, 22 nt, Artificial Sequence
  Synthetic
uuccauacaucgggugguggaa

SEQ ID NO: 6534 - RNA, 23 nt, Artificial Sequence
  Synthetic
uuuccauacaucgggugguggaa

SEQ ID NO: 6535 - RNA, 24 nt, Artificial Sequence
  Synthetic
guuuccauacaucgggugguggaa

SEQ ID NO: 6536 - RNA, 18 nt, Artificial Sequence
  Synthetic
ucuccaccacagacaaca

SEQ ID NO: 6537 - RNA, 19 nt, Artificial Sequence
  Synthetic
aucuccaccacagacaaca

SEQ ID NO: 6538 - RNA, 20 nt, Artificial Sequence
  Synthetic
caucuccaccacagacaaca

SEQ ID NO: 6539 - RNA, 21 nt, Artificial Sequence
  Synthetic
ccaucuccaccacagacaaca

SEQ ID NO: 6540 - RNA, 22 nt, Artificial Sequence
  Synthetic
gccaucuccaccacagacaaca

SEQ ID NO: 6541 - RNA, 23 nt, Artificial Sequence
  Synthetic
agccaucuccaccacagacaaca

SEQ ID NO: 6542 - RNA, 24 nt, Artificial Sequence
  Synthetic
cagccaucuccaccacagacaaca

SEQ ID NO: 6543 - RNA, 18 nt, Artificial Sequence
  Synthetic
uucugguugcacuggaca

SEQ ID NO: 6544 - RNA, 19 nt, Artificial Sequence
  Synthetic
guucugguugcacuggaca

SEQ ID NO: 6545 - RNA, 20 nt, Artificial Sequence
  Synthetic
uguucugguugcacuggaca

SEQ ID NO: 6546 - RNA, 21 nt, Artificial Sequence
  Synthetic
uuguucugguugcacuggaca

SEQ ID NO: 6547 - RNA, 22 nt, Artificial Sequence
  Synthetic
uuuguucugguugcacuggaca

SEQ ID NO: 6548 - RNA, 23 nt, Artificial Sequence
  Synthetic
auuuguucugguugcacuggaca

SEQ ID NO: 6549 - RNA, 24 nt, Artificial Sequence
  Synthetic
gauuuguucugguugcacuggaca

SEQ ID NO: 6550 - RNA, 18 nt, Artificial Sequence
  Synthetic
gcacgaccuaccgugaca

SEQ ID NO: 6551 - RNA, 19 nt, Artificial Sequence
  Synthetic
ggcacgaccuaccgugaca

SEQ ID NO: 6552 - RNA, 20 nt, Artificial Sequence
  Synthetic
aggcacgaccuaccgugaca

SEQ ID NO: 6553 - RNA, 21 nt, Artificial Sequence
  Synthetic
caggcacgaccuaccgugaca

SEQ ID NO: 6554 - RNA, 22 nt, Artificial Sequence
  Synthetic
ccaggcacgaccuaccgugaca

SEQ ID NO: 6555 - RNA, 23 nt, Artificial Sequence
  Synthetic
uccaggcacgaccuaccgugaca

SEQ ID NO: 6556 - RNA, 24 nt, Artificial Sequence
  Synthetic
auccaggcacgaccuaccgugaca

SEQ ID NO: 6557 - RNA, 18 nt, Artificial Sequence
  Synthetic
caguacccuguggguaca

SEQ ID NO: 6558 - RNA, 19 nt, Artificial Sequence
  Synthetic
gcaguacccuguggguaca

SEQ ID NO: 6559 - RNA, 20 nt, Artificial Sequence
  Synthetic
agcaguacccuguggguaca

SEQ ID NO: 6560 - RNA, 21 nt, Artificial Sequence
  Synthetic
uagcaguacccuguggguaca

SEQ ID NO: 6561 - RNA, 22 nt, Artificial Sequence
  Synthetic
guagcaguacccuguggguaca

SEQ ID NO: 6562 - RNA, 23 nt, Artificial Sequence
  Synthetic
aguagcaguacccuguggguaca

SEQ ID NO: 6563 - RNA, 24 nt, Artificial Sequence
  Synthetic
uaguagcaguacccuguggguaca

SEQ ID NO: 6564 - RNA, 18 nt, Artificial Sequence
  Synthetic
ccucucagggccccccca

SEQ ID NO: 6565 - RNA, 19 nt, Artificial Sequence
  Synthetic
cccucucagggccccccca

SEQ ID NO: 6566 - RNA, 20 nt, Artificial Sequence
  Synthetic
ucccucucagggccccccca

SEQ ID NO: 6567 - RNA, 21 nt, Artificial Sequence
  Synthetic
uucccucucagggccccccca

SEQ ID NO: 6568 - RNA, 22 nt, Artificial Sequence
  Synthetic
cuucccucucagggccccccca

SEQ ID NO: 6569 - RNA, 23 nt, Artificial Sequence
  Synthetic
ccuucccucucagggccccccca

SEQ ID NO: 6570 - RNA, 24 nt, Artificial Sequence
  Synthetic
uccuucccucucagggccccccca

SEQ ID NO: 6571 - RNA, 18 nt, Artificial Sequence
  Synthetic
ggcgccauggagcaagca

SEQ ID NO: 6572 - RNA, 19 nt, Artificial Sequence
  Synthetic
gggcgccauggagcaagca

SEQ ID NO: 6573 - RNA, 21 nt, Artificial Sequence
  Synthetic
gagggcgccauggagcaagca

SEQ ID NO: 6574 - RNA, 22 nt, Artificial Sequence
  Synthetic
agagggcgccauggagcaagca

SEQ ID NO: 6575 - RNA, 23 nt, Artificial Sequence
  Synthetic
cagagggcgccauggagcaagca

SEQ ID NO: 6576 - RNA, 24 nt, Artificial Sequence
  Synthetic
gcagagggcgccauggagcaagca

SEQ ID NO: 6577 - RNA, 18 nt, Artificial Sequence
  Synthetic
cagucacuguggacagca

SEQ ID NO: 6578 - RNA, 19 nt, Artificial Sequence
  Synthetic
ccagucacuguggacagca

SEQ ID NO: 6579 - RNA, 21 nt, Artificial Sequence
  Synthetic
ccccagucacuguggacagca

SEQ ID NO: 6580 - RNA, 22 nt, Artificial Sequence
  Synthetic
gccccagucacuguggacagca

SEQ ID NO: 6581 - RNA, 23 nt, Artificial Sequence
  Synthetic
ggccccagucacuguggacagca

SEQ ID NO: 6582 - RNA, 24 nt, Artificial Sequence
  Synthetic
gggccccagucacuguggacagca

SEQ ID NO: 6583 - RNA, 18 nt, Artificial Sequence
  Synthetic
caucgugaguaaccagca

SEQ ID NO: 6584 - RNA, 19 nt, Artificial Sequence
  Synthetic
ccaucgugaguaaccagca

SEQ ID NO: 6585 - RNA, 20 nt, Artificial Sequence
  Synthetic
gccaucgugaguaaccagca

SEQ ID NO: 6586 - RNA, 21 nt, Artificial Sequence
  Synthetic
ggccaucgugaguaaccagca

SEQ ID NO: 6587 - RNA, 22 nt, Artificial Sequence
  Synthetic
gggccaucgugaguaaccagca

SEQ ID NO: 6588 - RNA, 23 nt, Artificial Sequence
  Synthetic
agggccaucgugaguaaccagca

SEQ ID NO: 6589 - RNA, 24 nt, Artificial Sequence
  Synthetic
gagggccaucgugaguaaccagca

SEQ ID NO: 6590 - RNA, 18 nt, Artificial Sequence
  Synthetic
cguuguugauuccaggca

SEQ ID NO: 6591 - RNA, 19 nt, Artificial Sequence
  Synthetic
ccguuguugauuccaggca

SEQ ID NO: 6592 - RNA, 21 nt, Artificial Sequence
  Synthetic
caccguuguugauuccaggca

SEQ ID NO: 6593 - RNA, 22 nt, Artificial Sequence
  Synthetic
ucaccguuguugauuccaggca

SEQ ID NO: 6594 - RNA, 23 nt, Artificial Sequence
  Synthetic
cucaccguuguugauuccaggca

SEQ ID NO: 6595 - RNA, 24 nt, Artificial Sequence
  Synthetic
ucucaccguuguugauuccaggca

SEQ ID NO: 6596 - RNA, 18 nt, Artificial Sequence
  Synthetic
cccaggguggcauaggca

SEQ ID NO: 6597 - RNA, 19 nt, Artificial Sequence
  Synthetic
gcccaggguggcauaggca

SEQ ID NO: 6598 - RNA, 21 nt, Artificial Sequence
  Synthetic
gggcccaggguggcauaggca

SEQ ID NO: 6599 - RNA, 22 nt, Artificial Sequence
  Synthetic
ggggcccaggguggcauaggca

SEQ ID NO: 6600 - RNA, 23 nt, Artificial Sequence
  Synthetic
gggggcccaggguggcauaggca

SEQ ID NO: 6601 - RNA, 24 nt, Artificial Sequence
  Synthetic
cgggggcccaggguggcauaggca

SEQ ID NO: 6602 - RNA, 18 nt, Artificial Sequence
  Synthetic
gacagaccuaggggugca

SEQ ID NO: 6603 - RNA, 19 nt, Artificial Sequence
  Synthetic
ggacagaccuaggggugca

SEQ ID NO: 6604 - RNA, 20 nt, Artificial Sequence
  Synthetic
gggacagaccuaggggugca

SEQ ID NO: 6605 - RNA, 21 nt, Artificial Sequence
  Synthetic
agggacagaccuaggggugca

SEQ ID NO: 6606 - RNA, 22 nt, Artificial Sequence
  Synthetic
cagggacagaccuaggggugca

SEQ ID NO: 6607 - RNA, 23 nt, Artificial Sequence
  Synthetic
ucagggacagaccuaggggugca

SEQ ID NO: 6608 - RNA, 24 nt, Artificial Sequence
  Synthetic
aucagggacagaccuaggggugca

SEQ ID NO: 6609 - RNA, 18 nt, Artificial Sequence
  Synthetic
cgauuuguucugguugca

SEQ ID NO: 6610 - RNA, 19 nt, Artificial Sequence
  Synthetic
ccgauuuguucugguugca

SEQ ID NO: 6611 - RNA, 20 nt, Artificial Sequence
  Synthetic
uccgauuuguucugguugca

SEQ ID NO: 6612 - RNA, 21 nt, Artificial Sequence
  Synthetic
guccgauuuguucugguugca

SEQ ID NO: 6613 - RNA, 22 nt, Artificial Sequence
  Synthetic
aguccgauuuguucugguugca

SEQ ID NO: 6614 - RNA, 23 nt, Artificial Sequence
  Synthetic
caguccgauuuguucugguugca

SEQ ID NO: 6615 - RNA, 24 nt, Artificial Sequence
  Synthetic
gcaguccgauuuguucugguugca

SEQ ID NO: 6616 - RNA, 18 nt, Artificial Sequence
  Synthetic
acacagagacuagaguca

SEQ ID NO: 6617 - RNA, 19 nt, Artificial Sequence
  Synthetic
gacacagagacuagaguca

SEQ ID NO: 6618 - RNA, 20 nt, Artificial Sequence
  Synthetic
ggacacagagacuagaguca

SEQ ID NO: 6619 - RNA, 21 nt, Artificial Sequence
  Synthetic
uggacacagagacuagaguca

SEQ ID NO: 6620 - RNA, 22 nt, Artificial Sequence
  Synthetic
cuggacacagagacuagaguca

SEQ ID NO: 6621 - RNA, 23 nt, Artificial Sequence
  Synthetic
acuggacacagagacuagaguca

SEQ ID NO: 6622 - RNA, 24 nt, Artificial Sequence
  Synthetic
cacuggacacagagacuagaguca

SEQ ID NO: 6623 - RNA, 18 nt, Artificial Sequence
  Synthetic
cuguauuuguacagguca

SEQ ID NO: 6624 - RNA, 19 nt, Artificial Sequence
  Synthetic
gcuguauuuguacagguca

SEQ ID NO: 6625 - RNA, 20 nt, Artificial Sequence
  Synthetic
agcuguauuuguacagguca

SEQ ID NO: 6626 - RNA, 21 nt, Artificial Sequence
  Synthetic
gagcuguauuuguacagguca

SEQ ID NO: 6627 - RNA, 22 nt, Artificial Sequence
  Synthetic
ggagcuguauuuguacagguca

SEQ ID NO: 6628 - RNA, 23 nt, Artificial Sequence
  Synthetic
aggagcuguauuuguacagguca

SEQ ID NO: 6629 - RNA, 24 nt, Artificial Sequence
  Synthetic
aaggagcuguauuuguacagguca

SEQ ID NO: 6630 - RNA, 18 nt, Artificial Sequence
  Synthetic
acucuaccugggauguca

SEQ ID NO: 6631 - RNA, 19 nt, Artificial Sequence
  Synthetic
cacucuaccugggauguca

SEQ ID NO: 6632 - RNA, 20 nt, Artificial Sequence
  Synthetic
acacucuaccugggauguca

SEQ ID NO: 6633 - RNA, 21 nt, Artificial Sequence
  Synthetic
cacacucuaccugggauguca

SEQ ID NO: 6634 - RNA, 22 nt, Artificial Sequence
  Synthetic
ccacacucuaccugggauguca

SEQ ID NO: 6635 - RNA, 23 nt, Artificial Sequence
  Synthetic
cccacacucuaccugggauguca

SEQ ID NO: 6636 - RNA, 24 nt, Artificial Sequence
  Synthetic
ccccacacucuaccugggauguca

SEQ ID NO: 6637 - RNA, 18 nt, Artificial Sequence
  Synthetic
uuggaguuguucuuguca

SEQ ID NO: 6638 - RNA, 19 nt, Artificial Sequence
  Synthetic
guuggaguuguucuuguca

SEQ ID NO: 6639 - RNA, 20 nt, Artificial Sequence
  Synthetic
gguuggaguuguucuuguca

SEQ ID NO: 6640 - RNA, 21 nt, Artificial Sequence
  Synthetic
agguuggaguuguucuuguca

SEQ ID NO: 6641 - RNA, 22 nt, Artificial Sequence
  Synthetic
gagguuggaguuguucuuguca

SEQ ID NO: 6642 - RNA, 23 nt, Artificial Sequence
  Synthetic
agagguuggaguuguucuuguca

SEQ ID NO: 6643 - RNA, 24 nt, Artificial Sequence
  Synthetic
cagagguuggaguuguucuuguca

SEQ ID NO: 6644 - RNA, 18 nt, Artificial Sequence
  Synthetic
acccauuccuaggaaaga

SEQ ID NO: 6645 - RNA, 19 nt, Artificial Sequence
  Synthetic
gacccauuccuaggaaaga

SEQ ID NO: 6646 - RNA, 20 nt, Artificial Sequence
  Synthetic
agacccauuccuaggaaaga

SEQ ID NO: 6647 - RNA, 21 nt, Artificial Sequence
  Synthetic
aagacccauuccuaggaaaga

SEQ ID NO: 6648 - RNA, 22 nt, Artificial Sequence
  Synthetic
gaagacccauuccuaggaaaga

SEQ ID NO: 6649 - RNA, 23 nt, Artificial Sequence
  Synthetic
ggaagacccauuccuaggaaaga

SEQ ID NO: 6650 - RNA, 24 nt, Artificial Sequence
  Synthetic
uggaagacccauuccuaggaaaga

SEQ ID NO: 6651 - RNA, 18 nt, Artificial Sequence
  Synthetic
acgaccuaccgugacaga

SEQ ID NO: 6652 - RNA, 19 nt, Artificial Sequence
  Synthetic
cacgaccuaccgugacaga

SEQ ID NO: 6653 - RNA, 21 nt, Artificial Sequence
  Synthetic
ggcacgaccuaccgugacaga

SEQ ID NO: 6654 - RNA, 22 nt, Artificial Sequence
  Synthetic
aggcacgaccuaccgugacaga

SEQ ID NO: 6655 - RNA, 23 nt, Artificial Sequence
  Synthetic
caggcacgaccuaccgugacaga

SEQ ID NO: 6656 - RNA, 24 nt, Artificial Sequence
  Synthetic
ccaggcacgaccuaccgugacaga

SEQ ID NO: 6657 - RNA, 18 nt, Artificial Sequence
  Synthetic
cagaccuaggggugcaga

SEQ ID NO: 6658 - RNA, 19 nt, Artificial Sequence
  Synthetic
acagaccuaggggugcaga

SEQ ID NO: 6659 - RNA, 20 nt, Artificial Sequence
  Synthetic
gacagaccuaggggugcaga

SEQ ID NO: 6660 - RNA, 21 nt, Artificial Sequence
  Synthetic
ggacagaccuaggggugcaga

SEQ ID NO: 6661 - RNA, 22 nt, Artificial Sequence
  Synthetic
gggacagaccuaggggugcaga

SEQ ID NO: 6662 - RNA, 23 nt, Artificial Sequence
  Synthetic
agggacagaccuaggggugcaga

SEQ ID NO: 6663 - RNA, 24 nt, Artificial Sequence
  Synthetic
cagggacagaccuaggggugcaga

SEQ ID NO: 6664 - RNA, 18 nt, Artificial Sequence
  Synthetic
acagagacuagagucaga

SEQ ID NO: 6665 - RNA, 19 nt, Artificial Sequence
  Synthetic
cacagagacuagagucaga

SEQ ID NO: 6666 - RNA, 21 nt, Artificial Sequence
  Synthetic
gacacagagacuagagucaga

SEQ ID NO: 6667 - RNA, 22 nt, Artificial Sequence
  Synthetic
ggacacagagacuagagucaga

SEQ ID NO: 6668 - RNA, 23 nt, Artificial Sequence
  Synthetic
uggacacagagacuagagucaga

SEQ ID NO: 6669 - RNA, 24 nt, Artificial Sequence
  Synthetic
cuggacacagagacuagagucaga

SEQ ID NO: 6670 - RNA, 18 nt, Artificial Sequence
  Synthetic
ggcugucaaggcuggaga

SEQ ID NO: 6671 - RNA, 19 nt, Artificial Sequence
  Synthetic
gggcugucaaggcuggaga

SEQ ID NO: 6672 - RNA, 21 nt, Artificial Sequence
  Synthetic
aggggcugucaaggcuggaga

SEQ ID NO: 6673 - RNA, 22 nt, Artificial Sequence
  Synthetic
gaggggcugucaaggcuggaga

SEQ ID NO: 6674 - RNA, 23 nt, Artificial Sequence
  Synthetic
ggaggggcugucaaggcuggaga

SEQ ID NO: 6675 - RNA, 24 nt, Artificial Sequence
  Synthetic
gggaggggcugucaaggcuggaga

SEQ ID NO: 6676 - RNA, 18 nt, Artificial Sequence
  Synthetic
ggguaccugaaggggcga

SEQ ID NO: 6677 - RNA, 19 nt, Artificial Sequence
  Synthetic
cggguaccugaaggggcga

SEQ ID NO: 6678 - RNA, 21 nt, Artificial Sequence
  Synthetic
uccggguaccugaaggggcga

SEQ ID NO: 6679 - RNA, 22 nt, Artificial Sequence
  Synthetic
uuccggguaccugaaggggcga

SEQ ID NO: 6680 - RNA, 23 nt, Artificial Sequence
  Synthetic
uuuccggguaccugaaggggcga

SEQ ID NO: 6681 - RNA, 24 nt, Artificial Sequence
  Synthetic
auuuccggguaccugaaggggcga

SEQ ID NO: 6682 - RNA, 18 nt, Artificial Sequence
  Synthetic
gccuggcugggacaagga

SEQ ID NO: 6683 - RNA, 19 nt, Artificial Sequence
  Synthetic
ggccuggcugggacaagga

SEQ ID NO: 6684 - RNA, 20 nt, Artificial Sequence
  Synthetic
gggccuggcugggacaagga

SEQ ID NO: 6685 - RNA, 21 nt, Artificial Sequence
  Synthetic
agggccuggcugggacaagga

SEQ ID NO: 6686 - RNA, 22 nt, Artificial Sequence
  Synthetic
cagggccuggcugggacaagga

SEQ ID NO: 6687 - RNA, 23 nt, Artificial Sequence
  Synthetic
gcagggccuggcugggacaagga

SEQ ID NO: 6688 - RNA, 24 nt, Artificial Sequence
  Synthetic
agcagggccuggcugggacaagga

SEQ ID NO: 6689 - RNA, 18 nt, Artificial Sequence
  Synthetic
gggcagaagugggaagga

SEQ ID NO: 6690 - RNA, 19 nt, Artificial Sequence
  Synthetic
ggggcagaagugggaagga

SEQ ID NO: 6691 - RNA, 21 nt, Artificial Sequence
  Synthetic
ugggggcagaagugggaagga

SEQ ID NO: 6692 - RNA, 22 nt, Artificial Sequence
  Synthetic
gugggggcagaagugggaagga

SEQ ID NO: 6693 - RNA, 23 nt, Artificial Sequence
  Synthetic
ggugggggcagaagugggaagga

SEQ ID NO: 6694 - RNA, 24 nt, Artificial Sequence
  Synthetic
gggugggggcagaagugggaagga

SEQ ID NO: 6695 - RNA, 18 nt, Artificial Sequence
  Synthetic
aguaauuccuuaucagga

SEQ ID NO: 6696 - RNA, 19 nt, Artificial Sequence
  Synthetic
gaguaauuccuuaucagga

SEQ ID NO: 6697 - RNA, 20 nt, Artificial Sequence
  Synthetic
agaguaauuccuuaucagga

SEQ ID NO: 6698 - RNA, 21 nt, Artificial Sequence
  Synthetic
gagaguaauuccuuaucagga

SEQ ID NO: 6699 - RNA, 22 nt, Artificial Sequence
  Synthetic
ugagaguaauuccuuaucagga

SEQ ID NO: 6700 - RNA, 23 nt, Artificial Sequence
  Synthetic
gugagaguaauuccuuaucagga

SEQ ID NO: 6701 - RNA, 24 nt, Artificial Sequence
  Synthetic
agugagaguaauuccuuaucagga

SEQ ID NO: 6702 - RNA, 18 nt, Artificial Sequence
  Synthetic
ggaggaggguggagagga

SEQ ID NO: 6703 - RNA, 19 nt, Artificial Sequence
  Synthetic
gggaggaggguggagagga

SEQ ID NO: 6704 - RNA, 20 nt, Artificial Sequence
  Synthetic
agggaggaggguggagagga

SEQ ID NO: 6705 - RNA, 21 nt, Artificial Sequence
  Synthetic
aagggaggaggguggagagga

SEQ ID NO: 6706 - RNA, 22 nt, Artificial Sequence
  Synthetic
gaagggaggaggguggagagga

SEQ ID NO: 6707 - RNA, 23 nt, Artificial Sequence
  Synthetic
ggaagggaggaggguggagagga

SEQ ID NO: 6708 - RNA, 24 nt, Artificial Sequence
  Synthetic
uggaagggaggaggguggagagga

SEQ ID NO: 6709 - RNA, 18 nt, Artificial Sequence
  Synthetic
acguucuggggccgcgga

SEQ ID NO: 6710 - RNA, 19 nt, Artificial Sequence
  Synthetic
cacguucuggggccgcgga

SEQ ID NO: 6711 - RNA, 20 nt, Artificial Sequence
  Synthetic
ccacguucuggggccgcgga

SEQ ID NO: 6712 - RNA, 21 nt, Artificial Sequence
  Synthetic
uccacguucuggggccgcgga

SEQ ID NO: 6713 - RNA, 22 nt, Artificial Sequence
  Synthetic
cuccacguucuggggccgcgga

SEQ ID NO: 6714 - RNA, 23 nt, Artificial Sequence
  Synthetic
acuccacguucuggggccgcgga

SEQ ID NO: 6715 - RNA, 24 nt, Artificial Sequence
  Synthetic
uacuccacguucuggggccgcgga

SEQ ID NO: 6716 - RNA, 18 nt, Artificial Sequence
  Synthetic
acuguggacagcagggga

SEQ ID NO: 6717 - RNA, 19 nt, Artificial Sequence
  Synthetic
cacuguggacagcagggga

SEQ ID NO: 6718 - RNA, 20 nt, Artificial Sequence
  Synthetic
ucacuguggacagcagggga

SEQ ID NO: 6719 - RNA, 21 nt, Artificial Sequence
  Synthetic
gucacuguggacagcagggga

SEQ ID NO: 6720 - RNA, 22 nt, Artificial Sequence
  Synthetic
agucacuguggacagcagggga

SEQ ID NO: 6721 - RNA, 23 nt, Artificial Sequence
  Synthetic
cagucacuguggacagcagggga

SEQ ID NO: 6722 - RNA, 24 nt, Artificial Sequence
  Synthetic
ccagucacuguggacagcagggga

SEQ ID NO: 6723 - RNA, 18 nt, Artificial Sequence
  Synthetic
agcuggucacgcugggga

SEQ ID NO: 6724 - RNA, 19 nt, Artificial Sequence
  Synthetic
uagcuggucacgcugggga

SEQ ID NO: 6725 - RNA, 21 nt, Artificial Sequence
  Synthetic
gguagcuggucacgcugggga

SEQ ID NO: 6726 - RNA, 22 nt, Artificial Sequence
  Synthetic
ugguagcuggucacgcugggga

SEQ ID NO: 6727 - RNA, 23 nt, Artificial Sequence
  Synthetic
cugguagcuggucacgcugggga

SEQ ID NO: 6728 - RNA, 24 nt, Artificial Sequence
  Synthetic
gcugguagcuggucacgcugggga

SEQ ID NO: 6729 - RNA, 18 nt, Artificial Sequence
  Synthetic
gugggggcagaaguggga

SEQ ID NO: 6730 - RNA, 19 nt, Artificial Sequence
  Synthetic
ggugggggcagaaguggga

SEQ ID NO: 6731 - RNA, 21 nt, Artificial Sequence
  Synthetic
ggggugggggcagaaguggga

SEQ ID NO: 6732 - RNA, 22 nt, Artificial Sequence
  Synthetic
uggggugggggcagaaguggga

SEQ ID NO: 6733 - RNA, 23 nt, Artificial Sequence
  Synthetic
auggggugggggcagaaguggga

SEQ ID NO: 6734 - RNA, 24 nt, Artificial Sequence
  Synthetic
cauggggugggggcagaaguggga

SEQ ID NO: 6735 - RNA, 18 nt, Artificial Sequence
  Synthetic
agugaauacacaccugga

SEQ ID NO: 6736 - RNA, 19 nt, Artificial Sequence
  Synthetic
gagugaauacacaccugga

SEQ ID NO: 6737 - RNA, 21 nt, Artificial Sequence
  Synthetic
aggagugaauacacaccugga

SEQ ID NO: 6738 - RNA, 22 nt, Artificial Sequence
  Synthetic
caggagugaauacacaccugga

SEQ ID NO: 6739 - RNA, 23 nt, Artificial Sequence
  Synthetic
gcaggagugaauacacaccugga

SEQ ID NO: 6740 - RNA, 24 nt, Artificial Sequence
  Synthetic
agcaggagugaauacacaccugga

SEQ ID NO: 6741 - RNA, 18 nt, Artificial Sequence
  Synthetic
ggggcugucaaggcugga

SEQ ID NO: 6742 - RNA, 19 nt, Artificial Sequence
  Synthetic
aggggcugucaaggcugga

SEQ ID NO: 6743 - RNA, 20 nt, Artificial Sequence
  Synthetic
gaggggcugucaaggcugga

SEQ ID NO: 6744 - RNA, 21 nt, Artificial Sequence
  Synthetic
ggaggggcugucaaggcugga

SEQ ID NO: 6745 - RNA, 22 nt, Artificial Sequence
  Synthetic
gggaggggcugucaaggcugga

SEQ ID NO: 6746 - RNA, 23 nt, Artificial Sequence
  Synthetic
ggggaggggcugucaaggcugga

SEQ ID NO: 6747 - RNA, 24 nt, Artificial Sequence
  Synthetic
gggggaggggcugucaaggcugga

SEQ ID NO: 6748 - RNA, 18 nt, Artificial Sequence
  Synthetic
ggaagggaggagggugga

SEQ ID NO: 6749 - RNA, 19 nt, Artificial Sequence
  Synthetic
uggaagggaggagggugga

SEQ ID NO: 6750 - RNA, 20 nt, Artificial Sequence
  Synthetic
cuggaagggaggagggugga

SEQ ID NO: 6751 - RNA, 21 nt, Artificial Sequence
  Synthetic
ccuggaagggaggagggugga

SEQ ID NO: 6752 - RNA, 22 nt, Artificial Sequence
  Synthetic
accuggaagggaggagggugga

SEQ ID NO: 6753 - RNA, 23 nt, Artificial Sequence
  Synthetic
caccuggaagggaggagggugga

SEQ ID NO: 6754 - RNA, 24 nt, Artificial Sequence
  Synthetic
acaccuggaagggaggagggugga

SEQ ID NO: 6755 - RNA, 18 nt, Artificial Sequence
  Synthetic
cuggcugcccagguugga

SEQ ID NO: 6756 - RNA, 19 nt, Artificial Sequence
  Synthetic
acuggcugcccagguugga

SEQ ID NO: 6757 - RNA, 20 nt, Artificial Sequence
  Synthetic
cacuggcugcccagguugga

SEQ ID NO: 6758 - RNA, 21 nt, Artificial Sequence
  Synthetic
ccacuggcugcccagguugga

SEQ ID NO: 6759 - RNA, 22 nt, Artificial Sequence
  Synthetic
uccacuggcugcccagguugga

SEQ ID NO: 6760 - RNA, 23 nt, Artificial Sequence
  Synthetic
cuccacuggcugcccagguugga

SEQ ID NO: 6761 - RNA, 24 nt, Artificial Sequence
  Synthetic
gcuccacuggcugcccagguugga

SEQ ID NO: 6762 - RNA, 18 nt, Artificial Sequence
  Synthetic
uaauuuccggguaccuga

SEQ ID NO: 6763 - RNA, 19 nt, Artificial Sequence
  Synthetic
uuaauuuccggguaccuga

SEQ ID NO: 6764 - RNA, 21 nt, Artificial Sequence
  Synthetic
cuuuaauuuccggguaccuga

SEQ ID NO: 6765 - RNA, 22 nt, Artificial Sequence
  Synthetic
ucuuuaauuuccggguaccuga

SEQ ID NO: 6766 - RNA, 23 nt, Artificial Sequence
  Synthetic
cucuuuaauuuccggguaccuga

SEQ ID NO: 6767 - RNA, 24 nt, Artificial Sequence
  Synthetic
ccucuuuaauuuccggguaccuga

SEQ ID NO: 6768 - RNA, 18 nt, Artificial Sequence
  Synthetic
uugccuuccucaugcuga

SEQ ID NO: 6769 - RNA, 19 nt, Artificial Sequence
  Synthetic
cuugccuuccucaugcuga

SEQ ID NO: 6770 - RNA, 21 nt, Artificial Sequence
  Synthetic
uccuugccuuccucaugcuga

SEQ ID NO: 6771 - RNA, 22 nt, Artificial Sequence
  Synthetic
auccuugccuuccucaugcuga

SEQ ID NO: 6772 - RNA, 23 nt, Artificial Sequence
  Synthetic
cauccuugccuuccucaugcuga

SEQ ID NO: 6773 - RNA, 24 nt, Artificial Sequence
  Synthetic
gcauccuugccuuccucaugcuga

SEQ ID NO: 6774 - RNA, 18 nt, Artificial Sequence
  Synthetic
aggcacgaccuaccguga

SEQ ID NO: 6775 - RNA, 19 nt, Artificial Sequence
  Synthetic
caggcacgaccuaccguga

SEQ ID NO: 6776 - RNA, 20 nt, Artificial Sequence
  Synthetic
ccaggcacgaccuaccguga

SEQ ID NO: 6777 - RNA, 21 nt, Artificial Sequence
  Synthetic
uccaggcacgaccuaccguga

SEQ ID NO: 6778 - RNA, 22 nt, Artificial Sequence
  Synthetic
auccaggcacgaccuaccguga

SEQ ID NO: 6779 - RNA, 23 nt, Artificial Sequence
  Synthetic
cauccaggcacgaccuaccguga

SEQ ID NO: 6780 - RNA, 24 nt, Artificial Sequence
  Synthetic
ccauccaggcacgaccuaccguga

SEQ ID NO: 6781 - RNA, 18 nt, Artificial Sequence
  Synthetic
cggccacgagagugguga

SEQ ID NO: 6782 - RNA, 19 nt, Artificial Sequence
  Synthetic
ccggccacgagagugguga

SEQ ID NO: 6783 - RNA, 21 nt, Artificial Sequence
  Synthetic
agccggccacgagagugguga

SEQ ID NO: 6784 - RNA, 22 nt, Artificial Sequence
  Synthetic
gagccggccacgagagugguga

SEQ ID NO: 6785 - RNA, 23 nt, Artificial Sequence
  Synthetic
ggagccggccacgagagugguga

SEQ ID NO: 6786 - RNA, 24 nt, Artificial Sequence
  Synthetic
gggagccggccacgagagugguga

SEQ ID NO: 6787 - RNA, 18 nt, Artificial Sequence
  Synthetic
gagggugaccaucuguga

SEQ ID NO: 6788 - RNA, 19 nt, Artificial Sequence
  Synthetic
ggagggugaccaucuguga

SEQ ID NO: 6789 - RNA, 20 nt, Artificial Sequence
  Synthetic
aggagggugaccaucuguga

SEQ ID NO: 6790 - RNA, 21 nt, Artificial Sequence
  Synthetic
caggagggugaccaucuguga

SEQ ID NO: 6791 - RNA, 22 nt, Artificial Sequence
  Synthetic
acaggagggugaccaucuguga

SEQ ID NO: 6792 - RNA, 23 nt, Artificial Sequence
  Synthetic
gacaggagggugaccaucuguga

SEQ ID NO: 6793 - RNA, 24 nt, Artificial Sequence
  Synthetic
ggacaggagggugaccaucuguga

SEQ ID NO: 6794 - RNA, 18 nt, Artificial Sequence
  Synthetic
agcaguacccugugggua

SEQ ID NO: 6795 - RNA, 19 nt, Artificial Sequence
  Synthetic
uagcaguacccugugggua

SEQ ID NO: 6796 - RNA, 20 nt, Artificial Sequence
  Synthetic
guagcaguacccugugggua

SEQ ID NO: 6797 - RNA, 21 nt, Artificial Sequence
  Synthetic
aguagcaguacccugugggua

SEQ ID NO: 6798 - RNA, 22 nt, Artificial Sequence
  Synthetic
uaguagcaguacccugugggua

SEQ ID NO: 6799 - RNA, 23 nt, Artificial Sequence
  Synthetic
auaguagcaguacccugugggua

SEQ ID NO: 6800 - RNA, 24 nt, Artificial Sequence
  Synthetic
uauaguagcaguacccugugggua

SEQ ID NO: 6801 - RNA, 18 nt, Artificial Sequence
  Synthetic
cgacaggauguugaugua

SEQ ID NO: 6802 - RNA, 19 nt, Artificial Sequence
  Synthetic
ucgacaggauguugaugua

SEQ ID NO: 6803 - RNA, 20 nt, Artificial Sequence
  Synthetic
cucgacaggauguugaugua

SEQ ID NO: 6804 - RNA, 21 nt, Artificial Sequence
  Synthetic
ccucgacaggauguugaugua

SEQ ID NO: 6805 - RNA, 22 nt, Artificial Sequence
  Synthetic
gccucgacaggauguugaugua

SEQ ID NO: 6806 - RNA, 23 nt, Artificial Sequence
  Synthetic
agccucgacaggauguugaugua

SEQ ID NO: 6807 - RNA, 24 nt, Artificial Sequence
  Synthetic
cagccucgacaggauguugaugua

SEQ ID NO: 6808 - RNA, 18 nt, Artificial Sequence
  Synthetic
aggguaaagguucucaac

SEQ ID NO: 6809 - RNA, 19 nt, Artificial Sequence
  Synthetic
aaggguaaagguucucaac

SEQ ID NO: 6810 - RNA, 21 nt, Artificial Sequence
  Synthetic
ugaaggguaaagguucucaac

SEQ ID NO: 6811 - RNA, 22 nt, Artificial Sequence
  Synthetic
uugaaggguaaagguucucaac

SEQ ID NO: 6812 - RNA, 23 nt, Artificial Sequence
  Synthetic
uuugaaggguaaagguucucaac

SEQ ID NO: 6813 - RNA, 24 nt, Artificial Sequence
  Synthetic
cuuugaaggguaaagguucucaac

SEQ ID NO: 6814 - RNA, 18 nt, Artificial Sequence
  Synthetic
gucugaggagaagucaac

SEQ ID NO: 6815 - RNA, 19 nt, Artificial Sequence
  Synthetic
ggucugaggagaagucaac

SEQ ID NO: 6816 - RNA, 20 nt, Artificial Sequence
  Synthetic
uggucugaggagaagucaac

SEQ ID NO: 6817 - RNA, 21 nt, Artificial Sequence
  Synthetic
guggucugaggagaagucaac

SEQ ID NO: 6818 - RNA, 22 nt, Artificial Sequence
  Synthetic
gguggucugaggagaagucaac

SEQ ID NO: 6819 - RNA, 23 nt, Artificial Sequence
  Synthetic
agguggucugaggagaagucaac

SEQ ID NO: 6820 - RNA, 24 nt, Artificial Sequence
  Synthetic
cagguggucugaggagaagucaac

SEQ ID NO: 6821 - RNA, 18 nt, Artificial Sequence
  Synthetic
gcaggagugaauacacac

SEQ ID NO: 6822 - RNA, 19 nt, Artificial Sequence
  Synthetic
agcaggagugaauacacac

SEQ ID NO: 6823 - RNA, 20 nt, Artificial Sequence
  Synthetic
aagcaggagugaauacacac

SEQ ID NO: 6824 - RNA, 21 nt, Artificial Sequence
  Synthetic
gaagcaggagugaauacacac

SEQ ID NO: 6825 - RNA, 22 nt, Artificial Sequence
  Synthetic
ggaagcaggagugaauacacac

SEQ ID NO: 6826 - RNA, 23 nt, Artificial Sequence
  Synthetic
uggaagcaggagugaauacacac

SEQ ID NO: 6827 - RNA, 24 nt, Artificial Sequence
  Synthetic
cuggaagcaggagugaauacacac

SEQ ID NO: 6828 - RNA, 18 nt, Artificial Sequence
  Synthetic
ccaguccuuccaguccac

SEQ ID NO: 6829 - RNA, 19 nt, Artificial Sequence
  Synthetic
uccaguccuuccaguccac

SEQ ID NO: 6830 - RNA, 20 nt, Artificial Sequence
  Synthetic
uuccaguccuuccaguccac

SEQ ID NO: 6831 - RNA, 21 nt, Artificial Sequence
  Synthetic
cuuccaguccuuccaguccac

SEQ ID NO: 6832 - RNA, 22 nt, Artificial Sequence
  Synthetic
ucuuccaguccuuccaguccac

SEQ ID NO: 6833 - RNA, 23 nt, Artificial Sequence
  Synthetic
aucuuccaguccuuccaguccac

SEQ ID NO: 6834 - RNA, 24 nt, Artificial Sequence
  Synthetic
gaucuuccaguccuuccaguccac

SEQ ID NO: 6835 - RNA, 18 nt, Artificial Sequence
  Synthetic
ugggacaaggacagagac

SEQ ID NO: 6836 - RNA, 19 nt, Artificial Sequence
  Synthetic
cugggacaaggacagagac

SEQ ID NO: 6837 - RNA, 20 nt, Artificial Sequence
  Synthetic
gcugggacaaggacagagac

SEQ ID NO: 6838 - RNA, 21 nt, Artificial Sequence
  Synthetic
ggcugggacaaggacagagac

SEQ ID NO: 6839 - RNA, 22 nt, Artificial Sequence
  Synthetic
uggcugggacaaggacagagac

SEQ ID NO: 6840 - RNA, 23 nt, Artificial Sequence
  Synthetic
cuggcugggacaaggacagagac

SEQ ID NO: 6841 - RNA, 24 nt, Artificial Sequence
  Synthetic
ccuggcugggacaaggacagagac

SEQ ID NO: 6842 - RNA, 18 nt, Artificial Sequence
  Synthetic
gcagggccuggcugggac

SEQ ID NO: 6843 - RNA, 19 nt, Artificial Sequence
  Synthetic
agcagggccuggcugggac

SEQ ID NO: 6844 - RNA, 20 nt, Artificial Sequence
  Synthetic
gagcagggccuggcugggac

SEQ ID NO: 6845 - RNA, 21 nt, Artificial Sequence
  Synthetic
ggagcagggccuggcugggac

SEQ ID NO: 6846 - RNA, 22 nt, Artificial Sequence
  Synthetic
gggagcagggccuggcugggac

SEQ ID NO: 6847 - RNA, 23 nt, Artificial Sequence
  Synthetic
agggagcagggccuggcugggac

SEQ ID NO: 6848 - RNA, 24 nt, Artificial Sequence
  Synthetic
gagggagcagggccuggcugggac

SEQ ID NO: 6849 - RNA, 18 nt, Artificial Sequence
  Synthetic
uggcugcccagguuggac

SEQ ID NO: 6850 - RNA, 19 nt, Artificial Sequence
  Synthetic
cuggcugcccagguuggac

SEQ ID NO: 6851 - RNA, 21 nt, Artificial Sequence
  Synthetic
cacuggcugcccagguuggac

SEQ ID NO: 6852 - RNA, 22 nt, Artificial Sequence
  Synthetic
ccacuggcugcccagguuggac

SEQ ID NO: 6853 - RNA, 23 nt, Artificial Sequence
  Synthetic
uccacuggcugcccagguuggac

SEQ ID NO: 6854 - RNA, 24 nt, Artificial Sequence
  Synthetic
cuccacuggcugcccagguuggac

SEQ ID NO: 6855 - RNA, 18 nt, Artificial Sequence
  Synthetic
cccuuccccacacucuac

SEQ ID NO: 6856 - RNA, 19 nt, Artificial Sequence
  Synthetic
ucccuuccccacacucuac

SEQ ID NO: 6857 - RNA, 20 nt, Artificial Sequence
  Synthetic
aucccuuccccacacucuac

SEQ ID NO: 6858 - RNA, 21 nt, Artificial Sequence
  Synthetic
caucccuuccccacacucuac

SEQ ID NO: 6859 - RNA, 22 nt, Artificial Sequence
  Synthetic
ccaucccuuccccacacucuac

SEQ ID NO: 6860 - RNA, 23 nt, Artificial Sequence
  Synthetic
cccaucccuuccccacacucuac

SEQ ID NO: 6861 - RNA, 24 nt, Artificial Sequence
  Synthetic
acccaucccuuccccacacucuac

SEQ ID NO: 6862 - RNA, 18 nt, Artificial Sequence
  Synthetic
ucuuuaauuuccggguac

SEQ ID NO: 6863 - RNA, 19 nt, Artificial Sequence
  Synthetic
cucuuuaauuuccggguac

SEQ ID NO: 6864 - RNA, 20 nt, Artificial Sequence
  Synthetic
ccucuuuaauuuccggguac

SEQ ID NO: 6865 - RNA, 21 nt, Artificial Sequence
  Synthetic
uccucuuuaauuuccggguac

SEQ ID NO: 6866 - RNA, 22 nt, Artificial Sequence
  Synthetic
cuccucuuuaauuuccggguac

SEQ ID NO: 6867 - RNA, 23 nt, Artificial Sequence
  Synthetic
gcuccucuuuaauuuccggguac

SEQ ID NO: 6868 - RNA, 24 nt, Artificial Sequence
  Synthetic
agcuccucuuuaauuuccggguac

SEQ ID NO: 6869 - RNA, 18 nt, Artificial Sequence
  Synthetic
cugcccgugcaccauuac

SEQ ID NO: 6870 - RNA, 19 nt, Artificial Sequence
  Synthetic
ccugcccgugcaccauuac

SEQ ID NO: 6871 - RNA, 20 nt, Artificial Sequence
  Synthetic
uccugcccgugcaccauuac

SEQ ID NO: 6872 - RNA, 21 nt, Artificial Sequence
  Synthetic
auccugcccgugcaccauuac

SEQ ID NO: 6873 - RNA, 22 nt, Artificial Sequence
  Synthetic
cauccugcccgugcaccauuac

SEQ ID NO: 6874 - RNA, 23 nt, Artificial Sequence
  Synthetic
ucauccugcccgugcaccauuac

SEQ ID NO: 6875 - RNA, 24 nt, Artificial Sequence
  Synthetic
uucauccugcccgugcaccauuac

SEQ ID NO: 6876 - RNA, 18 nt, Artificial Sequence
  Synthetic
ucugaggagaagucaacc

SEQ ID NO: 6877 - RNA, 19 nt, Artificial Sequence
  Synthetic
gucugaggagaagucaacc

SEQ ID NO: 6878 - RNA, 21 nt, Artificial Sequence
  Synthetic
uggucugaggagaagucaacc

SEQ ID NO: 6879 - RNA, 22 nt, Artificial Sequence
  Synthetic
guggucugaggagaagucaacc

SEQ ID NO: 6880 - RNA, 23 nt, Artificial Sequence
  Synthetic
gguggucugaggagaagucaacc

SEQ ID NO: 6881 - RNA, 24 nt, Artificial Sequence
  Synthetic
agguggucugaggagaagucaacc

SEQ ID NO: 6882 - RNA, 18 nt, Artificial Sequence
  Synthetic
uccaccacagacaacacc

SEQ ID NO: 6883 - RNA, 19 nt, Artificial Sequence
  Synthetic
cuccaccacagacaacacc

SEQ ID NO: 6884 - RNA, 20 nt, Artificial Sequence
  Synthetic
ucuccaccacagacaacacc

SEQ ID NO: 6885 - RNA, 21 nt, Artificial Sequence
  Synthetic
aucuccaccacagacaacacc

SEQ ID NO: 6886 - RNA, 22 nt, Artificial Sequence
  Synthetic
caucuccaccacagacaacacc

SEQ ID NO: 6887 - RNA, 23 nt, Artificial Sequence
  Synthetic
ccaucuccaccacagacaacacc

SEQ ID NO: 6888 - RNA, 24 nt, Artificial Sequence
  Synthetic
gccaucuccaccacagacaacacc

SEQ ID NO: 6889 - RNA, 18 nt, Artificial Sequence
  Synthetic
caggagugaauacacacc

SEQ ID NO: 6890 - RNA, 19 nt, Artificial Sequence
  Synthetic
gcaggagugaauacacacc

SEQ ID NO: 6891 - RNA, 21 nt, Artificial Sequence
  Synthetic
aagcaggagugaauacacacc

SEQ ID NO: 6892 - RNA, 22 nt, Artificial Sequence
  Synthetic
gaagcaggagugaauacacacc

SEQ ID NO: 6893 - RNA, 23 nt, Artificial Sequence
  Synthetic
ggaagcaggagugaauacacacc

SEQ ID NO: 6894 - RNA, 24 nt, Artificial Sequence
  Synthetic
uggaagcaggagugaauacacacc

SEQ ID NO: 6895 - RNA, 18 nt, Artificial Sequence
  Synthetic
uaugaacccacauacacc

SEQ ID NO: 6896 - RNA, 19 nt, Artificial Sequence
  Synthetic
cuaugaacccacauacacc

SEQ ID NO: 6897 - RNA, 20 nt, Artificial Sequence
  Synthetic
ccuaugaacccacauacacc

SEQ ID NO: 6898 - RNA, 21 nt, Artificial Sequence
  Synthetic
uccuaugaacccacauacacc

SEQ ID NO: 6899 - RNA, 22 nt, Artificial Sequence
  Synthetic
uuccuaugaacccacauacacc

SEQ ID NO: 6900 - RNA, 23 nt, Artificial Sequence
  Synthetic
uuuccuaugaacccacauacacc

SEQ ID NO: 6901 - RNA, 24 nt, Artificial Sequence
  Synthetic
guuuccuaugaacccacauacacc

SEQ ID NO: 6902 - RNA, 18 nt, Artificial Sequence
  Synthetic
caguccuuccaguccacc

SEQ ID NO: 6903 - RNA, 19 nt, Artificial Sequence
  Synthetic
ccaguccuuccaguccacc

SEQ ID NO: 6904 - RNA, 21 nt, Artificial Sequence
  Synthetic
uuccaguccuuccaguccacc

SEQ ID NO: 6905 - RNA, 22 nt, Artificial Sequence
  Synthetic
cuuccaguccuuccaguccacc

SEQ ID NO: 6906 - RNA, 23 nt, Artificial Sequence
  Synthetic
ucuuccaguccuuccaguccacc

SEQ ID NO: 6907 - RNA, 24 nt, Artificial Sequence
  Synthetic
aucuuccaguccuuccaguccacc

SEQ ID NO: 6908 - RNA, 18 nt, Artificial Sequence
  Synthetic
ucuaccugggaugucacc

SEQ ID NO: 6909 - RNA, 19 nt, Artificial Sequence
  Synthetic
cucuaccugggaugucacc

SEQ ID NO: 6910 - RNA, 20 nt, Artificial Sequence
  Synthetic
acucuaccugggaugucacc

SEQ ID NO: 6911 - RNA, 21 nt, Artificial Sequence
  Synthetic
cacucuaccugggaugucacc

SEQ ID NO: 6912 - RNA, 22 nt, Artificial Sequence
  Synthetic
acacucuaccugggaugucacc

SEQ ID NO: 6913 - RNA, 23 nt, Artificial Sequence
  Synthetic
cacacucuaccugggaugucacc

SEQ ID NO: 6914 - RNA, 24 nt, Artificial Sequence
  Synthetic
ccacacucuaccugggaugucacc

SEQ ID NO: 6915 - RNA, 18 nt, Artificial Sequence
  Synthetic
cagcaucagggacagacc

SEQ ID NO: 6916 - RNA, 19 nt, Artificial Sequence
  Synthetic
gcagcaucagggacagacc

SEQ ID NO: 6917 - RNA, 20 nt, Artificial Sequence
  Synthetic
cgcagcaucagggacagacc

SEQ ID NO: 6918 - RNA, 21 nt, Artificial Sequence
  Synthetic
gcgcagcaucagggacagacc

SEQ ID NO: 6919 - RNA, 22 nt, Artificial Sequence
  Synthetic
cgcgcagcaucagggacagacc

SEQ ID NO: 6920 - RNA, 23 nt, Artificial Sequence
  Synthetic
gcgcgcagcaucagggacagacc

SEQ ID NO: 6921 - RNA, 24 nt, Artificial Sequence
  Synthetic
ugcgcgcagcaucagggacagacc

SEQ ID NO: 6922 - RNA, 18 nt, Artificial Sequence
  Synthetic
cucccuggagucucaccc

SEQ ID NO: 6923 - RNA, 19 nt, Artificial Sequence
  Synthetic
gcucccuggagucucaccc

SEQ ID NO: 6924 - RNA, 20 nt, Artificial Sequence
  Synthetic
ggcucccuggagucucaccc

SEQ ID NO: 6925 - RNA, 21 nt, Artificial Sequence
  Synthetic
gggcucccuggagucucaccc

SEQ ID NO: 6926 - RNA, 22 nt, Artificial Sequence
  Synthetic
ggggcucccuggagucucaccc

SEQ ID NO: 6927 - RNA, 23 nt, Artificial Sequence
  Synthetic
gggggcucccuggagucucaccc

SEQ ID NO: 6928 - RNA, 24 nt, Artificial Sequence
  Synthetic
ugggggcucccuggagucucaccc

SEQ ID NO: 6929 - RNA, 18 nt, Artificial Sequence
  Synthetic
ucccuggagucucacccc

SEQ ID NO: 6930 - RNA, 19 nt, Artificial Sequence
  Synthetic
cucccuggagucucacccc

SEQ ID NO: 6931 - RNA, 21 nt, Artificial Sequence
  Synthetic
ggcucccuggagucucacccc

SEQ ID NO: 6932 - RNA, 22 nt, Artificial Sequence
  Synthetic
gggcucccuggagucucacccc

SEQ ID NO: 6933 - RNA, 23 nt, Artificial Sequence
  Synthetic
ggggcucccuggagucucacccc

SEQ ID NO: 6934 - RNA, 24 nt, Artificial Sequence
  Synthetic
gggggcucccuggagucucacccc

SEQ ID NO: 6935 - RNA, 18 nt, Artificial Sequence
  Synthetic
ucccucucagggcccccc

SEQ ID NO: 6936 - RNA, 19 nt, Artificial Sequence
  Synthetic
uucccucucagggcccccc

SEQ ID NO: 6937 - RNA, 20 nt, Artificial Sequence
  Synthetic
cuucccucucagggcccccc

SEQ ID NO: 6938 - RNA, 21 nt, Artificial Sequence
  Synthetic
ccuucccucucagggcccccc

SEQ ID NO: 6939 - RNA, 22 nt, Artificial Sequence
  Synthetic
uccuucccucucagggcccccc

SEQ ID NO: 6940 - RNA, 23 nt, Artificial Sequence
  Synthetic
cuccuucccucucagggcccccc

SEQ ID NO: 6941 - RNA, 24 nt, Artificial Sequence
  Synthetic
ucuccuucccucucagggcccccc

SEQ ID NO: 6942 - RNA, 18 nt, Artificial Sequence
  Synthetic
ggccccugcagagccccc

SEQ ID NO: 6943 - RNA, 19 nt, Artificial Sequence
  Synthetic
uggccccugcagagccccc

SEQ ID NO: 6944 - RNA, 21 nt, Artificial Sequence
  Synthetic
acuggccccugcagagccccc

SEQ ID NO: 6945 - RNA, 22 nt, Artificial Sequence
  Synthetic
aacuggccccugcagagccccc

SEQ ID NO: 6946 - RNA, 23 nt, Artificial Sequence
  Synthetic
gaacuggccccugcagagccccc

SEQ ID NO: 6947 - RNA, 24 nt, Artificial Sequence
  Synthetic
ggaacuggccccugcagagccccc

SEQ ID NO: 6948 - RNA, 18 nt, Artificial Sequence
  Synthetic
uggccccugcagagcccc

SEQ ID NO: 6949 - RNA, 19 nt, Artificial Sequence
  Synthetic
cuggccccugcagagcccc

SEQ ID NO: 6950 - RNA, 20 nt, Artificial Sequence
  Synthetic
acuggccccugcagagcccc

SEQ ID NO: 6951 - RNA, 21 nt, Artificial Sequence
  Synthetic
aacuggccccugcagagcccc

SEQ ID NO: 6952 - RNA, 22 nt, Artificial Sequence
  Synthetic
gaacuggccccugcagagcccc

SEQ ID NO: 6953 - RNA, 23 nt, Artificial Sequence
  Synthetic
ggaacuggccccugcagagcccc

SEQ ID NO: 6954 - RNA, 24 nt, Artificial Sequence
  Synthetic
aggaacuggccccugcagagcccc

SEQ ID NO: 6955 - RNA, 18 nt, Artificial Sequence
  Synthetic
acgggcucgacgggcccc

SEQ ID NO: 6956 - RNA, 19 nt, Artificial Sequence
  Synthetic
uacgggcucgacgggcccc

SEQ ID NO: 6957 - RNA, 20 nt, Artificial Sequence
  Synthetic
cuacgggcucgacgggcccc

SEQ ID NO: 6958 - RNA, 21 nt, Artificial Sequence
  Synthetic
gcuacgggcucgacgggcccc

SEQ ID NO: 6959 - RNA, 22 nt, Artificial Sequence
  Synthetic
cgcuacgggcucgacgggcccc

SEQ ID NO: 6960 - RNA, 23 nt, Artificial Sequence
  Synthetic
acgcuacgggcucgacgggcccc

SEQ ID NO: 6961 - RNA, 24 nt, Artificial Sequence
  Synthetic
cacgcuacgggcucgacgggcccc

SEQ ID NO: 6962 - RNA, 18 nt, Artificial Sequence
  Synthetic
cggcugcgggagccggcc

SEQ ID NO: 6963 - RNA, 19 nt, Artificial Sequence
  Synthetic
acggcugcgggagccggcc

SEQ ID NO: 6964 - RNA, 20 nt, Artificial Sequence
  Synthetic
gacggcugcgggagccggcc

SEQ ID NO: 6965 - RNA, 21 nt, Artificial Sequence
  Synthetic
cgacggcugcgggagccggcc

SEQ ID NO: 6966 - RNA, 22 nt, Artificial Sequence
  Synthetic
gcgacggcugcgggagccggcc

SEQ ID NO: 6967 - RNA, 23 nt, Artificial Sequence
  Synthetic
cgcgacggcugcgggagccggcc

SEQ ID NO: 6968 - RNA, 24 nt, Artificial Sequence
  Synthetic
ucgcgacggcugcgggagccggcc

SEQ ID NO: 6969 - RNA, 18 nt, Artificial Sequence
  Synthetic
accccugcccccucggcc

SEQ ID NO: 6970 - RNA, 19 nt, Artificial Sequence
  Synthetic
caccccugcccccucggcc

SEQ ID NO: 6971 - RNA, 21 nt, Artificial Sequence
  Synthetic
agcaccccugcccccucggcc

SEQ ID NO: 6972 - RNA, 22 nt, Artificial Sequence
  Synthetic
gagcaccccugcccccucggcc

SEQ ID NO: 6973 - RNA, 23 nt, Artificial Sequence
  Synthetic
ugagcaccccugcccccucggcc

SEQ ID NO: 6974 - RNA, 24 nt, Artificial Sequence
  Synthetic
cugagcaccccugcccccucggcc

SEQ ID NO: 6975 - RNA, 18 nt, Artificial Sequence
  Synthetic
guuuuguaguucagcucc

SEQ ID NO: 6976 - RNA, 19 nt, Artificial Sequence
  Synthetic
gguuuuguaguucagcucc

SEQ ID NO: 6977 - RNA, 20 nt, Artificial Sequence
  Synthetic
ugguuuuguaguucagcucc

SEQ ID NO: 6978 - RNA, 21 nt, Artificial Sequence
  Synthetic
uugguuuuguaguucagcucc

SEQ ID NO: 6979 - RNA, 22 nt, Artificial Sequence
  Synthetic
auugguuuuguaguucagcucc

SEQ ID NO: 6980 - RNA, 23 nt, Artificial Sequence
  Synthetic
aauugguuuuguaguucagcucc

SEQ ID NO: 6981 - RNA, 24 nt, Artificial Sequence
  Synthetic
gaauugguuuuguaguucagcucc

SEQ ID NO: 6982 - RNA, 18 nt, Artificial Sequence
  Synthetic
uccuugaucaugcucucc

SEQ ID NO: 6983 - RNA, 19 nt, Artificial Sequence
  Synthetic
cuccuugaucaugcucucc

SEQ ID NO: 6984 - RNA, 21 nt, Artificial Sequence
  Synthetic
cacuccuugaucaugcucucc

SEQ ID NO: 6985 - RNA, 22 nt, Artificial Sequence
  Synthetic
acacuccuugaucaugcucucc

SEQ ID NO: 6986 - RNA, 23 nt, Artificial Sequence
  Synthetic
cacacuccuugaucaugcucucc

SEQ ID NO: 6987 - RNA, 24 nt, Artificial Sequence
  Synthetic
ccacacuccuugaucaugcucucc

SEQ ID NO: 6988 - RNA, 18 nt, Artificial Sequence
  Synthetic
aucuggaagacccauucc

SEQ ID NO: 6989 - RNA, 19 nt, Artificial Sequence
  Synthetic
caucuggaagacccauucc

SEQ ID NO: 6990 - RNA, 20 nt, Artificial Sequence
  Synthetic
gcaucuggaagacccauucc

SEQ ID NO: 6991 - RNA, 21 nt, Artificial Sequence
  Synthetic
agcaucuggaagacccauucc

SEQ ID NO: 6992 - RNA, 22 nt, Artificial Sequence
  Synthetic
uagcaucuggaagacccauucc

SEQ ID NO: 6993 - RNA, 23 nt, Artificial Sequence
  Synthetic
auagcaucuggaagacccauucc

SEQ ID NO: 6994 - RNA, 24 nt, Artificial Sequence
  Synthetic
gauagcaucuggaagacccauucc

SEQ ID NO: 6995 - RNA, 18 nt, Artificial Sequence
  Synthetic
gggcgccauggagcaagc

SEQ ID NO: 6996 - RNA, 19 nt, Artificial Sequence
  Synthetic
agggcgccauggagcaagc

SEQ ID NO: 6997 - RNA, 21 nt, Artificial Sequence
  Synthetic
agagggcgccauggagcaagc

SEQ ID NO: 6998 - RNA, 22 nt, Artificial Sequence
  Synthetic
cagagggcgccauggagcaagc

SEQ ID NO: 6999 - RNA, 23 nt, Artificial Sequence
  Synthetic
gcagagggcgccauggagcaagc

SEQ ID NO: 7000 - RNA, 24 nt, Artificial Sequence
  Synthetic
agcagagggcgccauggagcaagc

SEQ ID NO: 7001 - RNA, 18 nt, Artificial Sequence
  Synthetic
gguuguugucccgcaagc

SEQ ID NO: 7002 - RNA, 19 nt, Artificial Sequence
  Synthetic
ggguuguugucccgcaagc

SEQ ID NO: 7003 - RNA, 21 nt, Artificial Sequence
  Synthetic
ggggguuguugucccgcaagc

SEQ ID NO: 7004 - RNA, 22 nt, Artificial Sequence
  Synthetic
uggggguuguugucccgcaagc

SEQ ID NO: 7005 - RNA, 23 nt, Artificial Sequence
  Synthetic
cuggggguuguugucccgcaagc

SEQ ID NO: 7006 - RNA, 24 nt, Artificial Sequence
  Synthetic
ccuggggguuguugucccgcaagc

SEQ ID NO: 7007 - RNA, 18 nt, Artificial Sequence
  Synthetic
ccagucacuguggacagc

SEQ ID NO: 7008 - RNA, 19 nt, Artificial Sequence
  Synthetic
cccagucacuguggacagc

SEQ ID NO: 7009 - RNA, 21 nt, Artificial Sequence
  Synthetic
gccccagucacuguggacagc

SEQ ID NO: 7010 - RNA, 22 nt, Artificial Sequence
  Synthetic
ggccccagucacuguggacagc

SEQ ID NO: 7011 - RNA, 23 nt, Artificial Sequence
  Synthetic
gggccccagucacuguggacagc

SEQ ID NO: 7012 - RNA, 24 nt, Artificial Sequence
  Synthetic
cgggccccagucacuguggacagc

SEQ ID NO: 7013 - RNA, 18 nt, Artificial Sequence
  Synthetic
gcugcgggccucaccagc

SEQ ID NO: 7014 - RNA, 19 nt, Artificial Sequence
  Synthetic
cgcugcgggccucaccagc

SEQ ID NO: 7015 - RNA, 21 nt, Artificial Sequence
  Synthetic
ggcgcugcgggccucaccagc

SEQ ID NO: 7016 - RNA, 22 nt, Artificial Sequence
  Synthetic
cggcgcugcgggccucaccagc

SEQ ID NO: 7017 - RNA, 23 nt, Artificial Sequence
  Synthetic
ucggcgcugcgggccucaccagc

SEQ ID NO: 7018 - RNA, 24 nt, Artificial Sequence
  Synthetic
cucggcgcugcgggccucaccagc

SEQ ID NO: 7019 - RNA, 18 nt, Artificial Sequence
  Synthetic
cggaaccuucggagcagc

SEQ ID NO: 7020 - RNA, 19 nt, Artificial Sequence
  Synthetic
ucggaaccuucggagcagc

SEQ ID NO: 7021 - RNA, 20 nt, Artificial Sequence
  Synthetic
uucggaaccuucggagcagc

SEQ ID NO: 7022 - RNA, 21 nt, Artificial Sequence
  Synthetic
cuucggaaccuucggagcagc

SEQ ID NO: 7023 - RNA, 22 nt, Artificial Sequence
  Synthetic
gcuucggaaccuucggagcagc

SEQ ID NO: 7024 - RNA, 23 nt, Artificial Sequence
  Synthetic
ggcuucggaaccuucggagcagc

SEQ ID NO: 7025 - RNA, 24 nt, Artificial Sequence
  Synthetic
cggcuucggaaccuucggagcagc

SEQ ID NO: 7026 - RNA, 18 nt, Artificial Sequence
  Synthetic
gcugguagcuggucacgc

SEQ ID NO: 7027 - RNA, 19 nt, Artificial Sequence
  Synthetic
agcugguagcuggucacgc

SEQ ID NO: 7028 - RNA, 21 nt, Artificial Sequence
  Synthetic
agagcugguagcuggucacgc

SEQ ID NO: 7029 - RNA, 22 nt, Artificial Sequence
  Synthetic
gagagcugguagcuggucacgc

SEQ ID NO: 7030 - RNA, 23 nt, Artificial Sequence
  Synthetic
agagagcugguagcuggucacgc

SEQ ID NO: 7031 - RNA, 24 nt, Artificial Sequence
  Synthetic
cagagagcugguagcuggucacgc

SEQ ID NO: 7032 - RNA, 18 nt, Artificial Sequence
  Synthetic
gggaggggcugucaaggc

SEQ ID NO: 7033 - RNA, 19 nt, Artificial Sequence
  Synthetic
ggggaggggcugucaaggc

SEQ ID NO: 7034 - RNA, 21 nt, Artificial Sequence
  Synthetic
agggggaggggcugucaaggc

SEQ ID NO: 7035 - RNA, 22 nt, Artificial Sequence
  Synthetic
cagggggaggggcugucaaggc

SEQ ID NO: 7036 - RNA, 23 nt, Artificial Sequence
  Synthetic
gcagggggaggggcugucaaggc

SEQ ID NO: 7037 - RNA, 24 nt, Artificial Sequence
  Synthetic
ggcagggggaggggcugucaaggc

SEQ ID NO: 7038 - RNA, 18 nt, Artificial Sequence
  Synthetic
ccguuguugauuccaggc

SEQ ID NO: 7039 - RNA, 19 nt, Artificial Sequence
  Synthetic
accguuguugauuccaggc

SEQ ID NO: 7040 - RNA, 20 nt, Artificial Sequence
  Synthetic
caccguuguugauuccaggc

SEQ ID NO: 7041 - RNA, 21 nt, Artificial Sequence
  Synthetic
ucaccguuguugauuccaggc

SEQ ID NO: 7042 - RNA, 22 nt, Artificial Sequence
  Synthetic
cucaccguuguugauuccaggc

SEQ ID NO: 7043 - RNA, 23 nt, Artificial Sequence
  Synthetic
ucucaccguuguugauuccaggc

SEQ ID NO: 7044 - RNA, 24 nt, Artificial Sequence
  Synthetic
uucucaccguuguugauuccaggc

SEQ ID NO: 7045 - RNA, 18 nt, Artificial Sequence
  Synthetic
cgacgggccccgugaggc

SEQ ID NO: 7046 - RNA, 19 nt, Artificial Sequence
  Synthetic
ucgacgggccccgugaggc

SEQ ID NO: 7047 - RNA, 21 nt, Artificial Sequence
  Synthetic
gcucgacgggccccgugaggc

SEQ ID NO: 7048 - RNA, 22 nt, Artificial Sequence
  Synthetic
ggcucgacgggccccgugaggc

SEQ ID NO: 7049 - RNA, 23 nt, Artificial Sequence
  Synthetic
gggcucgacgggccccgugaggc

SEQ ID NO: 7050 - RNA, 24 nt, Artificial Sequence
  Synthetic
cgggcucgacgggccccgugaggc

SEQ ID NO: 7051 - RNA, 18 nt, Artificial Sequence
  Synthetic
gcccaggguggcauaggc

SEQ ID NO: 7052 - RNA, 19 nt, Artificial Sequence
  Synthetic
ggcccaggguggcauaggc

SEQ ID NO: 7053 - RNA, 21 nt, Artificial Sequence
  Synthetic
ggggcccaggguggcauaggc

SEQ ID NO: 7054 - RNA, 22 nt, Artificial Sequence
  Synthetic
gggggcccaggguggcauaggc

SEQ ID NO: 7055 - RNA, 23 nt, Artificial Sequence
  Synthetic
cgggggcccaggguggcauaggc

SEQ ID NO: 7056 - RNA, 24 nt, Artificial Sequence
  Synthetic
gcgggggcccaggguggcauaggc

SEQ ID NO: 7057 - RNA, 18 nt, Artificial Sequence
  Synthetic
caccccugcccccucggc

SEQ ID NO: 7058 - RNA, 19 nt, Artificial Sequence
  Synthetic
gcaccccugcccccucggc

SEQ ID NO: 7059 - RNA, 20 nt, Artificial Sequence
  Synthetic
agcaccccugcccccucggc

SEQ ID NO: 7060 - RNA, 21 nt, Artificial Sequence
  Synthetic
gagcaccccugcccccucggc

SEQ ID NO: 7061 - RNA, 22 nt, Artificial Sequence
  Synthetic
ugagcaccccugcccccucggc

SEQ ID NO: 7062 - RNA, 23 nt, Artificial Sequence
  Synthetic
cugagcaccccugcccccucggc

SEQ ID NO: 7063 - RNA, 24 nt, Artificial Sequence
  Synthetic
ccugagcaccccugcccccucggc

SEQ ID NO: 7064 - RNA, 18 nt, Artificial Sequence
  Synthetic
ccggguaccugaaggggc

SEQ ID NO: 7065 - RNA, 19 nt, Artificial Sequence
  Synthetic
uccggguaccugaaggggc

SEQ ID NO: 7066 - RNA, 20 nt, Artificial Sequence
  Synthetic
uuccggguaccugaaggggc

SEQ ID NO: 7067 - RNA, 21 nt, Artificial Sequence
  Synthetic
uuuccggguaccugaaggggc

SEQ ID NO: 7068 - RNA, 22 nt, Artificial Sequence
  Synthetic
auuuccggguaccugaaggggc

SEQ ID NO: 7069 - RNA, 23 nt, Artificial Sequence
  Synthetic
aauuuccggguaccugaaggggc

SEQ ID NO: 7070 - RNA, 24 nt, Artificial Sequence
  Synthetic
uaauuuccggguaccugaaggggc

SEQ ID NO: 7071 - RNA, 18 nt, Artificial Sequence
  Synthetic
agcccccuggagaugggc

SEQ ID NO: 7072 - RNA, 19 nt, Artificial Sequence
  Synthetic
gagcccccuggagaugggc

SEQ ID NO: 7073 - RNA, 21 nt, Artificial Sequence
  Synthetic
cagagcccccuggagaugggc

SEQ ID NO: 7074 - RNA, 22 nt, Artificial Sequence
  Synthetic
gcagagcccccuggagaugggc

SEQ ID NO: 7075 - RNA, 23 nt, Artificial Sequence
  Synthetic
ugcagagcccccuggagaugggc

SEQ ID NO: 7076 - RNA, 24 nt, Artificial Sequence
  Synthetic
cugcagagcccccuggagaugggc

SEQ ID NO: 7077 - RNA, 18 nt, Artificial Sequence
  Synthetic
gagggagcagggccuggc

SEQ ID NO: 7078 - RNA, 19 nt, Artificial Sequence
  Synthetic
agagggagcagggccuggc

SEQ ID NO: 7079 - RNA, 21 nt, Artificial Sequence
  Synthetic
ggagagggagcagggccuggc

SEQ ID NO: 7080 - RNA, 22 nt, Artificial Sequence
  Synthetic
uggagagggagcagggccuggc

SEQ ID NO: 7081 - RNA, 23 nt, Artificial Sequence
  Synthetic
cuggagagggagcagggccuggc

SEQ ID NO: 7082 - RNA, 24 nt, Artificial Sequence
  Synthetic
gcuggagagggagcagggccuggc

SEQ ID NO: 7083 - RNA, 18 nt, Artificial Sequence
  Synthetic
gggacccucaggcgcugc

SEQ ID NO: 7084 - RNA, 19 nt, Artificial Sequence
  Synthetic
cgggacccucaggcgcugc

SEQ ID NO: 7085 - RNA, 20 nt, Artificial Sequence
  Synthetic
gcgggacccucaggcgcugc

SEQ ID NO: 7086 - RNA, 21 nt, Artificial Sequence
  Synthetic
ggcgggacccucaggcgcugc

SEQ ID NO: 7087 - RNA, 22 nt, Artificial Sequence
  Synthetic
gggcgggacccucaggcgcugc

SEQ ID NO: 7088 - RNA, 23 nt, Artificial Sequence
  Synthetic
ggggcgggacccucaggcgcugc

SEQ ID NO: 7089 - RNA, 24 nt, Artificial Sequence
  Synthetic
gggggcgggacccucaggcgcugc

SEQ ID NO: 7090 - RNA, 18 nt, Artificial Sequence
  Synthetic
gcaggucgcgacggcugc

SEQ ID NO: 7091 - RNA, 19 nt, Artificial Sequence
  Synthetic
cgcaggucgcgacggcugc

SEQ ID NO: 7092 - RNA, 21 nt, Artificial Sequence
  Synthetic
cccgcaggucgcgacggcugc

SEQ ID NO: 7093 - RNA, 22 nt, Artificial Sequence
  Synthetic
ccccgcaggucgcgacggcugc

SEQ ID NO: 7094 - RNA, 23 nt, Artificial Sequence
  Synthetic
cccccgcaggucgcgacggcugc

SEQ ID NO: 7095 - RNA, 24 nt, Artificial Sequence
  Synthetic
ucccccgcaggucgcgacggcugc

SEQ ID NO: 7096 - RNA, 18 nt, Artificial Sequence
  Synthetic
ugacucacgccugguugc

SEQ ID NO: 7097 - RNA, 19 nt, Artificial Sequence
  Synthetic
cugacucacgccugguugc

SEQ ID NO: 7098 - RNA, 21 nt, Artificial Sequence
  Synthetic
gacugacucacgccugguugc

SEQ ID NO: 7099 - RNA, 22 nt, Artificial Sequence
  Synthetic
ggacugacucacgccugguugc

SEQ ID NO: 7100 - RNA, 23 nt, Artificial Sequence
  Synthetic
aggacugacucacgccugguugc

SEQ ID NO: 7101 - RNA, 24 nt, Artificial Sequence
  Synthetic
caggacugacucacgccugguugc

SEQ ID NO: 7102 - RNA, 18 nt, Artificial Sequence
  Synthetic
ccaggcauggaagacauc

SEQ ID NO: 7103 - RNA, 19 nt, Artificial Sequence
  Synthetic
uccaggcauggaagacauc

SEQ ID NO: 7104 - RNA, 20 nt, Artificial Sequence
  Synthetic
uuccaggcauggaagacauc

SEQ ID NO: 7105 - RNA, 21 nt, Artificial Sequence
  Synthetic
auuccaggcauggaagacauc

SEQ ID NO: 7106 - RNA, 22 nt, Artificial Sequence
  Synthetic
gauuccaggcauggaagacauc

SEQ ID NO: 7107 - RNA, 23 nt, Artificial Sequence
  Synthetic
ugauuccaggcauggaagacauc

SEQ ID NO: 7108 - RNA, 24 nt, Artificial Sequence
  Synthetic
uugauuccaggcauggaagacauc

SEQ ID NO: 7109 - RNA, 18 nt, Artificial Sequence
  Synthetic
ugcucugcgcgcagcauc

SEQ ID NO: 7110 - RNA, 19 nt, Artificial Sequence
  Synthetic
cugcucugcgcgcagcauc

SEQ ID NO: 7111 - RNA, 21 nt, Artificial Sequence
  Synthetic
uucugcucugcgcgcagcauc

SEQ ID NO: 7112 - RNA, 22 nt, Artificial Sequence
  Synthetic
auucugcucugcgcgcagcauc

SEQ ID NO: 7113 - RNA, 23 nt, Artificial Sequence
  Synthetic
cauucugcucugcgcgcagcauc

SEQ ID NO: 7114 - RNA, 24 nt, Artificial Sequence
  Synthetic
ucauucugcucugcgcgcagcauc

SEQ ID NO: 7115 - RNA, 18 nt, Artificial Sequence
  Synthetic
uucugucgcgauagcauc

SEQ ID NO: 7116 - RNA, 19 nt, Artificial Sequence
  Synthetic
guucugucgcgauagcauc

SEQ ID NO: 7117 - RNA, 21 nt, Artificial Sequence
  Synthetic
uuguucugucgcgauagcauc

SEQ ID NO: 7118 - RNA, 22 nt, Artificial Sequence
  Synthetic
auuguucugucgcgauagcauc

SEQ ID NO: 7119 - RNA, 23 nt, Artificial Sequence
  Synthetic
aauuguucugucgcgauagcauc

SEQ ID NO: 7120 - RNA, 24 nt, Artificial Sequence
  Synthetic
uaauuguucugucgcgauagcauc

SEQ ID NO: 7121 - RNA, 18 nt, Artificial Sequence
  Synthetic
ugagaguaauuccuuauc

SEQ ID NO: 7122 - RNA, 19 nt, Artificial Sequence
  Synthetic
gugagaguaauuccuuauc

SEQ ID NO: 7123 - RNA, 21 nt, Artificial Sequence
  Synthetic
aagugagaguaauuccuuauc

SEQ ID NO: 7124 - RNA, 22 nt, Artificial Sequence
  Synthetic
gaagugagaguaauuccuuauc

SEQ ID NO: 7125 - RNA, 23 nt, Artificial Sequence
  Synthetic
ggaagugagaguaauuccuuauc

SEQ ID NO: 7126 - RNA, 24 nt, Artificial Sequence
  Synthetic
uggaagugagaguaauuccuuauc

SEQ ID NO: 7127 - RNA, 18 nt, Artificial Sequence
  Synthetic
caggguggaggcuaccuc

SEQ ID NO: 7128 - RNA, 19 nt, Artificial Sequence
  Synthetic
ccaggguggaggcuaccuc

SEQ ID NO: 7129 - RNA, 20 nt, Artificial Sequence
  Synthetic
gccaggguggaggcuaccuc

SEQ ID NO: 7130 - RNA, 21 nt, Artificial Sequence
  Synthetic
ugccaggguggaggcuaccuc

SEQ ID NO: 7131 - RNA, 22 nt, Artificial Sequence
  Synthetic
augccaggguggaggcuaccuc

SEQ ID NO: 7132 - RNA, 23 nt, Artificial Sequence
  Synthetic
gaugccaggguggaggcuaccuc

SEQ ID NO: 7133 - RNA, 24 nt, Artificial Sequence
  Synthetic
ggaugccaggguggaggcuaccuc

SEQ ID NO: 7134 - RNA, 18 nt, Artificial Sequence
  Synthetic
gcccagcguguccuccuc

SEQ ID NO: 7135 - RNA, 19 nt, Artificial Sequence
  Synthetic
ugcccagcguguccuccuc

SEQ ID NO: 7136 - RNA, 20 nt, Artificial Sequence
  Synthetic
uugcccagcguguccuccuc

SEQ ID NO: 7137 - RNA, 21 nt, Artificial Sequence
  Synthetic
guugcccagcguguccuccuc

SEQ ID NO: 7138 - RNA, 22 nt, Artificial Sequence
  Synthetic
aguugcccagcguguccuccuc

SEQ ID NO: 7139 - RNA, 23 nt, Artificial Sequence
  Synthetic
aaguugcccagcguguccuccuc

SEQ ID NO: 7140 - RNA, 24 nt, Artificial Sequence
  Synthetic
gaaguugcccagcguguccuccuc

SEQ ID NO: 7141 - RNA, 18 nt, Artificial Sequence
  Synthetic
cuccuugaucaugcucuc

SEQ ID NO: 7142 - RNA, 19 nt, Artificial Sequence
  Synthetic
acuccuugaucaugcucuc

SEQ ID NO: 7143 - RNA, 20 nt, Artificial Sequence
  Synthetic
cacuccuugaucaugcucuc

SEQ ID NO: 7144 - RNA, 21 nt, Artificial Sequence
  Synthetic
acacuccuugaucaugcucuc

SEQ ID NO: 7145 - RNA, 22 nt, Artificial Sequence
  Synthetic
cacacuccuugaucaugcucuc

SEQ ID NO: 7146 - RNA, 23 nt, Artificial Sequence
  Synthetic
ccacacuccuugaucaugcucuc

SEQ ID NO: 7147 - RNA, 24 nt, Artificial Sequence
  Synthetic
gccacacuccuugaucaugcucuc

SEQ ID NO: 7148 - RNA, 18 nt, Artificial Sequence
  Synthetic
ucacaguacuccacguuc

SEQ ID NO: 7149 - RNA, 19 nt, Artificial Sequence
  Synthetic
gucacaguacuccacguuc

SEQ ID NO: 7150 - RNA, 21 nt, Artificial Sequence
  Synthetic
uagucacaguacuccacguuc

SEQ ID NO: 7151 - RNA, 22 nt, Artificial Sequence
  Synthetic
guagucacaguacuccacguuc

SEQ ID NO: 7152 - RNA, 23 nt, Artificial Sequence
  Synthetic
uguagucacaguacuccacguuc

SEQ ID NO: 7153 - RNA, 24 nt, Artificial Sequence
  Synthetic
cuguagucacaguacuccacguuc

SEQ ID NO: 7154 - RNA, 18 nt, Artificial Sequence
  Synthetic
augaccagcaggucaaag

SEQ ID NO: 7155 - RNA, 19 nt, Artificial Sequence
  Synthetic
gaugaccagcaggucaaag

SEQ ID NO: 7156 - RNA, 20 nt, Artificial Sequence
  Synthetic
ugaugaccagcaggucaaag

SEQ ID NO: 7157 - RNA, 21 nt, Artificial Sequence
  Synthetic
augaugaccagcaggucaaag

SEQ ID NO: 7158 - RNA, 22 nt, Artificial Sequence
  Synthetic
caugaugaccagcaggucaaag

SEQ ID NO: 7159 - RNA, 23 nt, Artificial Sequence
  Synthetic
acaugaugaccagcaggucaaag

SEQ ID NO: 7160 - RNA, 24 nt, Artificial Sequence
  Synthetic
aacaugaugaccagcaggucaaag

SEQ ID NO: 7161 - RNA, 18 nt, Artificial Sequence
  Synthetic
agggcgccauggagcaag

SEQ ID NO: 7162 - RNA, 19 nt, Artificial Sequence
  Synthetic
gagggcgccauggagcaag

SEQ ID NO: 7163 - RNA, 20 nt, Artificial Sequence
  Synthetic
agagggcgccauggagcaag

SEQ ID NO: 7164 - RNA, 21 nt, Artificial Sequence
  Synthetic
cagagggcgccauggagcaag

SEQ ID NO: 7165 - RNA, 22 nt, Artificial Sequence
  Synthetic
gcagagggcgccauggagcaag

SEQ ID NO: 7166 - RNA, 23 nt, Artificial Sequence
  Synthetic
agcagagggcgccauggagcaag

SEQ ID NO: 7167 - RNA, 24 nt, Artificial Sequence
  Synthetic
aagcagagggcgccauggagcaag

SEQ ID NO: 7168 - RNA, 18 nt, Artificial Sequence
  Synthetic
ggguuguugucccgcaag

SEQ ID NO: 7169 - RNA, 19 nt, Artificial Sequence
  Synthetic
gggguuguugucccgcaag

SEQ ID NO: 7170 - RNA, 20 nt, Artificial Sequence
  Synthetic
ggggguuguugucccgcaag

SEQ ID NO: 7171 - RNA, 21 nt, Artificial Sequence
  Synthetic
uggggguuguugucccgcaag

SEQ ID NO: 7172 - RNA, 22 nt, Artificial Sequence
  Synthetic
cuggggguuguugucccgcaag

SEQ ID NO: 7173 - RNA, 23 nt, Artificial Sequence
  Synthetic
ccuggggguuguugucccgcaag

SEQ ID NO: 7174 - RNA, 24 nt, Artificial Sequence
  Synthetic
accuggggguuguugucccgcaag

SEQ ID NO: 7175 - RNA, 18 nt, Artificial Sequence
  Synthetic
auggggugggggcagaag

SEQ ID NO: 7176 - RNA, 19 nt, Artificial Sequence
  Synthetic
cauggggugggggcagaag

SEQ ID NO: 7177 - RNA, 21 nt, Artificial Sequence
  Synthetic
gacauggggugggggcagaag

SEQ ID NO: 7178 - RNA, 22 nt, Artificial Sequence
  Synthetic
agacauggggugggggcagaag

SEQ ID NO: 7179 - RNA, 23 nt, Artificial Sequence
  Synthetic
gagacauggggugggggcagaag

SEQ ID NO: 7180 - RNA, 24 nt, Artificial Sequence
  Synthetic
agagacauggggugggggcagaag

SEQ ID NO: 7181 - RNA, 18 nt, Artificial Sequence
  Synthetic
uugaagcggcaggcgaag

SEQ ID NO: 7182 - RNA, 19 nt, Artificial Sequence
  Synthetic
guugaagcggcaggcgaag

SEQ ID NO: 7183 - RNA, 20 nt, Artificial Sequence
  Synthetic
gguugaagcggcaggcgaag

SEQ ID NO: 7184 - RNA, 21 nt, Artificial Sequence
  Synthetic
ugguugaagcggcaggcgaag

SEQ ID NO: 7185 - RNA, 22 nt, Artificial Sequence
  Synthetic
cugguugaagcggcaggcgaag

SEQ ID NO: 7186 - RNA, 23 nt, Artificial Sequence
  Synthetic
ccugguugaagcggcaggcgaag

SEQ ID NO: 7187 - RNA, 24 nt, Artificial Sequence
  Synthetic
accugguugaagcggcaggcgaag

SEQ ID NO: 7188 - RNA, 18 nt, Artificial Sequence
  Synthetic
gggggcagaagugggaag

SEQ ID NO: 7189 - RNA, 19 nt, Artificial Sequence
  Synthetic
ugggggcagaagugggaag

SEQ ID NO: 7190 - RNA, 20 nt, Artificial Sequence
  Synthetic
gugggggcagaagugggaag

SEQ ID NO: 7191 - RNA, 21 nt, Artificial Sequence
  Synthetic
ggugggggcagaagugggaag

SEQ ID NO: 7192 - RNA, 22 nt, Artificial Sequence
  Synthetic
gggugggggcagaagugggaag

SEQ ID NO: 7193 - RNA, 23 nt, Artificial Sequence
  Synthetic
ggggugggggcagaagugggaag

SEQ ID NO: 7194 - RNA, 24 nt, Artificial Sequence
  Synthetic
uggggugggggcagaagugggaag

SEQ ID NO: 7195 - RNA, 18 nt, Artificial Sequence
  Synthetic
aucaugcucuccuggaag

SEQ ID NO: 7196 - RNA, 19 nt, Artificial Sequence
  Synthetic
gaucaugcucuccuggaag

SEQ ID NO: 7197 - RNA, 20 nt, Artificial Sequence
  Synthetic
ugaucaugcucuccuggaag

SEQ ID NO: 7198 - RNA, 21 nt, Artificial Sequence
  Synthetic
uugaucaugcucuccuggaag

SEQ ID NO: 7199 - RNA, 22 nt, Artificial Sequence
  Synthetic
cuugaucaugcucuccuggaag

SEQ ID NO: 7200 - RNA, 23 nt, Artificial Sequence
  Synthetic
ccuugaucaugcucuccuggaag

SEQ ID NO: 7201 - RNA, 24 nt, Artificial Sequence
  Synthetic
uccuugaucaugcucuccuggaag

SEQ ID NO: 7202 - RNA, 18 nt, Artificial Sequence
  Synthetic
ggcccccccagaggacag

SEQ ID NO: 7203 - RNA, 19 nt, Artificial Sequence
  Synthetic
gggcccccccagaggacag

SEQ ID NO: 7204 - RNA, 20 nt, Artificial Sequence
  Synthetic
agggcccccccagaggacag

SEQ ID NO: 7205 - RNA, 21 nt, Artificial Sequence
  Synthetic
cagggcccccccagaggacag

SEQ ID NO: 7206 - RNA, 22 nt, Artificial Sequence
  Synthetic
ucagggcccccccagaggacag

SEQ ID NO: 7207 - RNA, 23 nt, Artificial Sequence
  Synthetic
cucagggcccccccagaggacag

SEQ ID NO: 7208 - RNA, 24 nt, Artificial Sequence
  Synthetic
ucucagggcccccccagaggacag

SEQ ID NO: 7209 - RNA, 18 nt, Artificial Sequence
  Synthetic
cccagucacuguggacag

SEQ ID NO: 7210 - RNA, 19 nt, Artificial Sequence
  Synthetic
ccccagucacuguggacag

SEQ ID NO: 7211 - RNA, 20 nt, Artificial Sequence
  Synthetic
gccccagucacuguggacag

SEQ ID NO: 7212 - RNA, 21 nt, Artificial Sequence
  Synthetic
ggccccagucacuguggacag

SEQ ID NO: 7213 - RNA, 22 nt, Artificial Sequence
  Synthetic
gggccccagucacuguggacag

SEQ ID NO: 7214 - RNA, 23 nt, Artificial Sequence
  Synthetic
cgggccccagucacuguggacag

SEQ ID NO: 7215 - RNA, 24 nt, Artificial Sequence
  Synthetic
ccgggccccagucacuguggacag

SEQ ID NO: 7216 - RNA, 18 nt, Artificial Sequence
  Synthetic
cacgaccuaccgugacag

SEQ ID NO: 7217 - RNA, 19 nt, Artificial Sequence
  Synthetic
gcacgaccuaccgugacag

SEQ ID NO: 7218 - RNA, 21 nt, Artificial Sequence
  Synthetic
aggcacgaccuaccgugacag

SEQ ID NO: 7219 - RNA, 22 nt, Artificial Sequence
  Synthetic
caggcacgaccuaccgugacag

SEQ ID NO: 7220 - RNA, 23 nt, Artificial Sequence
  Synthetic
ccaggcacgaccuaccgugacag

SEQ ID NO: 7221 - RNA, 24 nt, Artificial Sequence
  Synthetic
uccaggcacgaccuaccgugacag

SEQ ID NO: 7222 - RNA, 18 nt, Artificial Sequence
  Synthetic
gccaucgugaguaaccag

SEQ ID NO: 7223 - RNA, 19 nt, Artificial Sequence
  Synthetic
ggccaucgugaguaaccag

SEQ ID NO: 7224 - RNA, 20 nt, Artificial Sequence
  Synthetic
gggccaucgugaguaaccag

SEQ ID NO: 7225 - RNA, 21 nt, Artificial Sequence
  Synthetic
agggccaucgugaguaaccag

SEQ ID NO: 7226 - RNA, 22 nt, Artificial Sequence
  Synthetic
gagggccaucgugaguaaccag

SEQ ID NO: 7227 - RNA, 23 nt, Artificial Sequence
  Synthetic
cgagggccaucgugaguaaccag

SEQ ID NO: 7228 - RNA, 24 nt, Artificial Sequence
  Synthetic
ccgagggccaucgugaguaaccag

SEQ ID NO: 7229 - RNA, 18 nt, Artificial Sequence
  Synthetic
cgcugcgggccucaccag

SEQ ID NO: 7230 - RNA, 19 nt, Artificial Sequence
  Synthetic
gcgcugcgggccucaccag

SEQ ID NO: 7231 - RNA, 20 nt, Artificial Sequence
  Synthetic
ggcgcugcgggccucaccag

SEQ ID NO: 7232 - RNA, 21 nt, Artificial Sequence
  Synthetic
cggcgcugcgggccucaccag

SEQ ID NO: 7233 - RNA, 22 nt, Artificial Sequence
  Synthetic
ucggcgcugcgggccucaccag

SEQ ID NO: 7234 - RNA, 23 nt, Artificial Sequence
  Synthetic
cucggcgcugcgggccucaccag

SEQ ID NO: 7235 - RNA, 24 nt, Artificial Sequence
  Synthetic
ccucggcgcugcgggccucaccag

SEQ ID NO: 7236 - RNA, 18 nt, Artificial Sequence
  Synthetic
ccaggguggcauaggcag

SEQ ID NO: 7237 - RNA, 19 nt, Artificial Sequence
  Synthetic
cccaggguggcauaggcag

SEQ ID NO: 7238 - RNA, 21 nt, Artificial Sequence
  Synthetic
ggcccaggguggcauaggcag

SEQ ID NO: 7239 - RNA, 22 nt, Artificial Sequence
  Synthetic
gggcccaggguggcauaggcag

SEQ ID NO: 7240 - RNA, 23 nt, Artificial Sequence
  Synthetic
ggggcccaggguggcauaggcag

SEQ ID NO: 7241 - RNA, 24 nt, Artificial Sequence
  Synthetic
gggggcccaggguggcauaggcag

SEQ ID NO: 7242 - RNA, 18 nt, Artificial Sequence
  Synthetic
accugguugaagcggcag

SEQ ID NO: 7243 - RNA, 19 nt, Artificial Sequence
  Synthetic
gaccugguugaagcggcag

SEQ ID NO: 7244 - RNA, 20 nt, Artificial Sequence
  Synthetic
agaccugguugaagcggcag

SEQ ID NO: 7245 - RNA, 21 nt, Artificial Sequence
  Synthetic
gagaccugguugaagcggcag

SEQ ID NO: 7246 - RNA, 22 nt, Artificial Sequence
  Synthetic
ggagaccugguugaagcggcag

SEQ ID NO: 7247 - RNA, 23 nt, Artificial Sequence
  Synthetic
aggagaccugguugaagcggcag

SEQ ID NO: 7248 - RNA, 24 nt, Artificial Sequence
  Synthetic
caggagaccugguugaagcggcag

SEQ ID NO: 7249 - RNA, 18 nt, Artificial Sequence
  Synthetic
cacagagacuagagucag

SEQ ID NO: 7250 - RNA, 19 nt, Artificial Sequence
  Synthetic
acacagagacuagagucag

SEQ ID NO: 7251 - RNA, 21 nt, Artificial Sequence
  Synthetic
ggacacagagacuagagucag

SEQ ID NO: 7252 - RNA, 22 nt, Artificial Sequence
  Synthetic
uggacacagagacuagagucag

SEQ ID NO: 7253 - RNA, 23 nt, Artificial Sequence
  Synthetic
cuggacacagagacuagagucag

SEQ ID NO: 7254 - RNA, 24 nt, Artificial Sequence
  Synthetic
acuggacacagagacuagagucag

SEQ ID NO: 7255 - RNA, 18 nt, Artificial Sequence
  Synthetic
agggaggaggguggagag

SEQ ID NO: 7256 - RNA, 19 nt, Artificial Sequence
  Synthetic
aagggaggaggguggagag

SEQ ID NO: 7257 - RNA, 20 nt, Artificial Sequence
  Synthetic
gaagggaggaggguggagag

SEQ ID NO: 7258 - RNA, 21 nt, Artificial Sequence
  Synthetic
ggaagggaggaggguggagag

SEQ ID NO: 7259 - RNA, 22 nt, Artificial Sequence
  Synthetic
uggaagggaggaggguggagag

SEQ ID NO: 7260 - RNA, 23 nt, Artificial Sequence
  Synthetic
cuggaagggaggaggguggagag

SEQ ID NO: 7261 - RNA, 24 nt, Artificial Sequence
  Synthetic
ccuggaagggaggaggguggagag

SEQ ID NO: 7262 - RNA, 18 nt, Artificial Sequence
  Synthetic
ggugaccaucugugagag

SEQ ID NO: 7263 - RNA, 19 nt, Artificial Sequence
  Synthetic
gggugaccaucugugagag

SEQ ID NO: 7264 - RNA, 20 nt, Artificial Sequence
  Synthetic
agggugaccaucugugagag

SEQ ID NO: 7265 - RNA, 21 nt, Artificial Sequence
  Synthetic
gagggugaccaucugugagag

SEQ ID NO: 7266 - RNA, 22 nt, Artificial Sequence
  Synthetic
ggagggugaccaucugugagag

SEQ ID NO: 7267 - RNA, 23 nt, Artificial Sequence
  Synthetic
aggagggugaccaucugugagag

SEQ ID NO: 7268 - RNA, 24 nt, Artificial Sequence
  Synthetic
caggagggugaccaucugugagag

SEQ ID NO: 7269 - RNA, 18 nt, Artificial Sequence
  Synthetic
gguaccugaaggggcgag

SEQ ID NO: 7270 - RNA, 19 nt, Artificial Sequence
  Synthetic
ggguaccugaaggggcgag

SEQ ID NO: 7271 - RNA, 21 nt, Artificial Sequence
  Synthetic
ccggguaccugaaggggcgag

SEQ ID NO: 7272 - RNA, 22 nt, Artificial Sequence
  Synthetic
uccggguaccugaaggggcgag

SEQ ID NO: 7273 - RNA, 23 nt, Artificial Sequence
  Synthetic
uuccggguaccugaaggggcgag

SEQ ID NO: 7274 - RNA, 24 nt, Artificial Sequence
  Synthetic
uuuccggguaccugaaggggcgag

SEQ ID NO: 7275 - RNA, 18 nt, Artificial Sequence
  Synthetic
ggcagaagugggaaggag

SEQ ID NO: 7276 - RNA, 19 nt, Artificial Sequence
  Synthetic
gggcagaagugggaaggag

SEQ ID NO: 7277 - RNA, 21 nt, Artificial Sequence
  Synthetic
gggggcagaagugggaaggag

SEQ ID NO: 7278 - RNA, 22 nt, Artificial Sequence
  Synthetic
ugggggcagaagugggaaggag

SEQ ID NO: 7279 - RNA, 23 nt, Artificial Sequence
  Synthetic
gugggggcagaagugggaaggag

SEQ ID NO: 7280 - RNA, 24 nt, Artificial Sequence
  Synthetic
ggugggggcagaagugggaaggag

SEQ ID NO: 7281 - RNA, 18 nt, Artificial Sequence
  Synthetic
acagacaacaccgaggag

SEQ ID NO: 7282 - RNA, 19 nt, Artificial Sequence
  Synthetic
cacagacaacaccgaggag

SEQ ID NO: 7283 - RNA, 20 nt, Artificial Sequence
  Synthetic
ccacagacaacaccgaggag

SEQ ID NO: 7284 - RNA, 21 nt, Artificial Sequence
  Synthetic
accacagacaacaccgaggag

SEQ ID NO: 7285 - RNA, 22 nt, Artificial Sequence
  Synthetic
caccacagacaacaccgaggag

SEQ ID NO: 7286 - RNA, 23 nt, Artificial Sequence
  Synthetic
ccaccacagacaacaccgaggag

SEQ ID NO: 7287 - RNA, 24 nt, Artificial Sequence
  Synthetic
uccaccacagacaacaccgaggag

SEQ ID NO: 7288 - RNA, 18 nt, Artificial Sequence
  Synthetic
ucaaggcuggagagggag

SEQ ID NO: 7289 - RNA, 19 nt, Artificial Sequence
  Synthetic
gucaaggcuggagagggag

SEQ ID NO: 7290 - RNA, 20 nt, Artificial Sequence
  Synthetic
ugucaaggcuggagagggag

SEQ ID NO: 7291 - RNA, 21 nt, Artificial Sequence
  Synthetic
cugucaaggcuggagagggag

SEQ ID NO: 7292 - RNA, 22 nt, Artificial Sequence
  Synthetic
gcugucaaggcuggagagggag

SEQ ID NO: 7293 - RNA, 23 nt, Artificial Sequence
  Synthetic
ggcugucaaggcuggagagggag

SEQ ID NO: 7294 - RNA, 24 nt, Artificial Sequence
  Synthetic
gggcugucaaggcuggagagggag

SEQ ID NO: 7295 - RNA, 18 nt, Artificial Sequence
  Synthetic
cugcagagcccccuggag

SEQ ID NO: 7296 - RNA, 19 nt, Artificial Sequence
  Synthetic
ccugcagagcccccuggag

SEQ ID NO: 7297 - RNA, 20 nt, Artificial Sequence
  Synthetic
cccugcagagcccccuggag

SEQ ID NO: 7298 - RNA, 21 nt, Artificial Sequence
  Synthetic
ccccugcagagcccccuggag

SEQ ID NO: 7299 - RNA, 22 nt, Artificial Sequence
  Synthetic
gccccugcagagcccccuggag

SEQ ID NO: 7300 - RNA, 23 nt, Artificial Sequence
  Synthetic
ggccccugcagagcccccuggag

SEQ ID NO: 7301 - RNA, 24 nt, Artificial Sequence
  Synthetic
uggccccugcagagcccccuggag

SEQ ID NO: 7302 - RNA, 18 nt, Artificial Sequence
  Synthetic
gggcugucaaggcuggag

SEQ ID NO: 7303 - RNA, 19 nt, Artificial Sequence
  Synthetic
ggggcugucaaggcuggag

SEQ ID NO: 7304 - RNA, 21 nt, Artificial Sequence
  Synthetic
gaggggcugucaaggcuggag

SEQ ID NO: 7305 - RNA, 22 nt, Artificial Sequence
  Synthetic
ggaggggcugucaaggcuggag

SEQ ID NO: 7306 - RNA, 23 nt, Artificial Sequence
  Synthetic
gggaggggcugucaaggcuggag

SEQ ID NO: 7307 - RNA, 24 nt, Artificial Sequence
  Synthetic
ggggaggggcugucaaggcuggag

SEQ ID NO: 7308 - RNA, 18 nt, Artificial Sequence
  Synthetic
gaagggaggaggguggag

SEQ ID NO: 7309 - RNA, 19 nt, Artificial Sequence
  Synthetic
ggaagggaggaggguggag

SEQ ID NO: 7310 - RNA, 21 nt, Artificial Sequence
  Synthetic
cuggaagggaggaggguggag

SEQ ID NO: 7311 - RNA, 22 nt, Artificial Sequence
  Synthetic
ccuggaagggaggaggguggag

SEQ ID NO: 7312 - RNA, 23 nt, Artificial Sequence
  Synthetic
accuggaagggaggaggguggag

SEQ ID NO: 7313 - RNA, 24 nt, Artificial Sequence
  Synthetic
caccuggaagggaggaggguggag

SEQ ID NO: 7314 - RNA, 18 nt, Artificial Sequence
  Synthetic
cagcccagguggucugag

SEQ ID NO: 7315 - RNA, 19 nt, Artificial Sequence
  Synthetic
acagcccagguggucugag

SEQ ID NO: 7316 - RNA, 20 nt, Artificial Sequence
  Synthetic
aacagcccagguggucugag

SEQ ID NO: 7317 - RNA, 21 nt, Artificial Sequence
  Synthetic
aaacagcccagguggucugag

SEQ ID NO: 7318 - RNA, 22 nt, Artificial Sequence
  Synthetic
gaaacagcccagguggucugag

SEQ ID NO: 7319 - RNA, 23 nt, Artificial Sequence
  Synthetic
ugaaacagcccagguggucugag

SEQ ID NO: 7320 - RNA, 24 nt, Artificial Sequence
  Synthetic
gugaaacagcccagguggucugag

SEQ ID NO: 7321 - RNA, 18 nt, Artificial Sequence
  Synthetic
cucgacgggccccgugag

SEQ ID NO: 7322 - RNA, 19 nt, Artificial Sequence
  Synthetic
gcucgacgggccccgugag

SEQ ID NO: 7323 - RNA, 20 nt, Artificial Sequence
  Synthetic
ggcucgacgggccccgugag

SEQ ID NO: 7324 - RNA, 21 nt, Artificial Sequence
  Synthetic
gggcucgacgggccccgugag

SEQ ID NO: 7325 - RNA, 22 nt, Artificial Sequence
  Synthetic
cgggcucgacgggccccgugag

SEQ ID NO: 7326 - RNA, 23 nt, Artificial Sequence
  Synthetic
acgggcucgacgggccccgugag

SEQ ID NO: 7327 - RNA, 24 nt, Artificial Sequence
  Synthetic
uacgggcucgacgggccccgugag

SEQ ID NO: 7328 - RNA, 18 nt, Artificial Sequence
  Synthetic
agggugaccaucugugag

SEQ ID NO: 7329 - RNA, 19 nt, Artificial Sequence
  Synthetic
gagggugaccaucugugag

SEQ ID NO: 7330 - RNA, 21 nt, Artificial Sequence
  Synthetic
aggagggugaccaucugugag

SEQ ID NO: 7331 - RNA, 22 nt, Artificial Sequence
  Synthetic
caggagggugaccaucugugag

SEQ ID NO: 7332 - RNA, 23 nt, Artificial Sequence
  Synthetic
acaggagggugaccaucugugag

SEQ ID NO: 7333 - RNA, 24 nt, Artificial Sequence
  Synthetic
gacaggagggugaccaucugugag

SEQ ID NO: 7334 - RNA, 18 nt, Artificial Sequence
  Synthetic
gacaggauguugauguag

SEQ ID NO: 7335 - RNA, 19 nt, Artificial Sequence
  Synthetic
cgacaggauguugauguag

SEQ ID NO: 7336 - RNA, 21 nt, Artificial Sequence
  Synthetic
cucgacaggauguugauguag

SEQ ID NO: 7337 - RNA, 22 nt, Artificial Sequence
  Synthetic
ccucgacaggauguugauguag

SEQ ID NO: 7338 - RNA, 23 nt, Artificial Sequence
  Synthetic
gccucgacaggauguugauguag

SEQ ID NO: 7339 - RNA, 24 nt, Artificial Sequence
  Synthetic
agccucgacaggauguugauguag

SEQ ID NO: 7340 - RNA, 18 nt, Artificial Sequence
  Synthetic
agcugguagcuggucacg

SEQ ID NO: 7341 - RNA, 19 nt, Artificial Sequence
  Synthetic
gagcugguagcuggucacg

SEQ ID NO: 7342 - RNA, 20 nt, Artificial Sequence
  Synthetic
agagcugguagcuggucacg

SEQ ID NO: 7343 - RNA, 21 nt, Artificial Sequence
  Synthetic
gagagcugguagcuggucacg

SEQ ID NO: 7344 - RNA, 22 nt, Artificial Sequence
  Synthetic
agagagcugguagcuggucacg

SEQ ID NO: 7345 - RNA, 23 nt, Artificial Sequence
  Synthetic
cagagagcugguagcuggucacg

SEQ ID NO: 7346 - RNA, 24 nt, Artificial Sequence
  Synthetic
gcagagagcugguagcuggucacg

SEQ ID NO: 7347 - RNA, 18 nt, Artificial Sequence
  Synthetic
aggagagguacauugacg

SEQ ID NO: 7348 - RNA, 19 nt, Artificial Sequence
  Synthetic
gaggagagguacauugacg

SEQ ID NO: 7349 - RNA, 20 nt, Artificial Sequence
  Synthetic
agaggagagguacauugacg

SEQ ID NO: 7350 - RNA, 21 nt, Artificial Sequence
  Synthetic
gagaggagagguacauugacg

SEQ ID NO: 7351 - RNA, 22 nt, Artificial Sequence
  Synthetic
ugagaggagagguacauugacg

SEQ ID NO: 7352 - RNA, 23 nt, Artificial Sequence
  Synthetic
gugagaggagagguacauugacg

SEQ ID NO: 7353 - RNA, 24 nt, Artificial Sequence
  Synthetic
ugugagaggagagguacauugacg

SEQ ID NO: 7354 - RNA, 18 nt, Artificial Sequence
  Synthetic
ccaccacagacaacaccg

SEQ ID NO: 7355 - RNA, 19 nt, Artificial Sequence
  Synthetic
uccaccacagacaacaccg

SEQ ID NO: 7356 - RNA, 21 nt, Artificial Sequence
  Synthetic
ucuccaccacagacaacaccg

SEQ ID NO: 7357 - RNA, 22 nt, Artificial Sequence
  Synthetic
aucuccaccacagacaacaccg

SEQ ID NO: 7358 - RNA, 23 nt, Artificial Sequence
  Synthetic
caucuccaccacagacaacaccg

SEQ ID NO: 7359 - RNA, 24 nt, Artificial Sequence
  Synthetic
ccaucuccaccacagacaacaccg

SEQ ID NO: 7360 - RNA, 18 nt, Artificial Sequence
  Synthetic
cggguaccugaaggggcg

SEQ ID NO: 7361 - RNA, 19 nt, Artificial Sequence
  Synthetic
ccggguaccugaaggggcg

SEQ ID NO: 7362 - RNA, 21 nt, Artificial Sequence
  Synthetic
uuccggguaccugaaggggcg

SEQ ID NO: 7363 - RNA, 22 nt, Artificial Sequence
  Synthetic
uuuccggguaccugaaggggcg

SEQ ID NO: 7364 - RNA, 23 nt, Artificial Sequence
  Synthetic
auuuccggguaccugaaggggcg

SEQ ID NO: 7365 - RNA, 24 nt, Artificial Sequence
  Synthetic
aauuuccggguaccugaaggggcg

SEQ ID NO: 7366 - RNA, 18 nt, Artificial Sequence
  Synthetic
ggccacgcuacgggcucg

SEQ ID NO: 7367 - RNA, 19 nt, Artificial Sequence
  Synthetic
aggccacgcuacgggcucg

SEQ ID NO: 7368 - RNA, 20 nt, Artificial Sequence
  Synthetic
gaggccacgcuacgggcucg

SEQ ID NO: 7369 - RNA, 21 nt, Artificial Sequence
  Synthetic
ggaggccacgcuacgggcucg

SEQ ID NO: 7370 - RNA, 22 nt, Artificial Sequence
  Synthetic
uggaggccacgcuacgggcucg

SEQ ID NO: 7371 - RNA, 23 nt, Artificial Sequence
  Synthetic
cuggaggccacgcuacgggcucg

SEQ ID NO: 7372 - RNA, 24 nt, Artificial Sequence
  Synthetic
gcuggaggccacgcuacgggcucg

SEQ ID NO: 7373 - RNA, 18 nt, Artificial Sequence
  Synthetic
ggggaggggcugucaagg

SEQ ID NO: 7374 - RNA, 19 nt, Artificial Sequence
  Synthetic
gggggaggggcugucaagg

SEQ ID NO: 7375 - RNA, 20 nt, Artificial Sequence
  Synthetic
agggggaggggcugucaagg

SEQ ID NO: 7376 - RNA, 21 nt, Artificial Sequence
  Synthetic
cagggggaggggcugucaagg

SEQ ID NO: 7377 - RNA, 22 nt, Artificial Sequence
  Synthetic
gcagggggaggggcugucaagg

SEQ ID NO: 7378 - RNA, 23 nt, Artificial Sequence
  Synthetic
ggcagggggaggggcugucaagg

SEQ ID NO: 7379 - RNA, 24 nt, Artificial Sequence
  Synthetic
aggcagggggaggggcugucaagg

SEQ ID NO: 7380 - RNA, 18 nt, Artificial Sequence
  Synthetic
ggggcagaagugggaagg

SEQ ID NO: 7381 - RNA, 19 nt, Artificial Sequence
  Synthetic
gggggcagaagugggaagg

SEQ ID NO: 7382 - RNA, 21 nt, Artificial Sequence
  Synthetic
gugggggcagaagugggaagg

SEQ ID NO: 7383 - RNA, 22 nt, Artificial Sequence
  Synthetic
ggugggggcagaagugggaagg

SEQ ID NO: 7384 - RNA, 23 nt, Artificial Sequence
  Synthetic
gggugggggcagaagugggaagg

SEQ ID NO: 7385 - RNA, 24 nt, Artificial Sequence
  Synthetic
ggggugggggcagaagugggaagg

SEQ ID NO: 7386 - RNA, 18 nt, Artificial Sequence
  Synthetic
gaauacacaccuggaagg

SEQ ID NO: 7387 - RNA, 19 nt, Artificial Sequence
  Synthetic
ugaauacacaccuggaagg

SEQ ID NO: 7388 - RNA, 20 nt, Artificial Sequence
  Synthetic
gugaauacacaccuggaagg

SEQ ID NO: 7389 - RNA, 21 nt, Artificial Sequence
  Synthetic
agugaauacacaccuggaagg

SEQ ID NO: 7390 - RNA, 22 nt, Artificial Sequence
  Synthetic
gagugaauacacaccuggaagg

SEQ ID NO: 7391 - RNA, 23 nt, Artificial Sequence
  Synthetic
ggagugaauacacaccuggaagg

SEQ ID NO: 7392 - RNA, 24 nt, Artificial Sequence
  Synthetic
aggagugaauacacaccuggaagg

SEQ ID NO: 7393 - RNA, 18 nt, Artificial Sequence
  Synthetic
gcccccccagaggacagg

SEQ ID NO: 7394 - RNA, 19 nt, Artificial Sequence
  Synthetic
ggcccccccagaggacagg

SEQ ID NO: 7395 - RNA, 21 nt, Artificial Sequence
  Synthetic
agggcccccccagaggacagg

SEQ ID NO: 7396 - RNA, 22 nt, Artificial Sequence
  Synthetic
cagggcccccccagaggacagg

SEQ ID NO: 7397 - RNA, 23 nt, Artificial Sequence
  Synthetic
ucagggcccccccagaggacagg

SEQ ID NO: 7398 - RNA, 24 nt, Artificial Sequence
  Synthetic
cucagggcccccccagaggacagg

SEQ ID NO: 7399 - RNA, 18 nt, Artificial Sequence
  Synthetic
cuccacuggcugcccagg

SEQ ID NO: 7400 - RNA, 19 nt, Artificial Sequence
  Synthetic
gcuccacuggcugcccagg

SEQ ID NO: 7401 - RNA, 20 nt, Artificial Sequence
  Synthetic
ggcuccacuggcugcccagg

SEQ ID NO: 7402 - RNA, 21 nt, Artificial Sequence
  Synthetic
aggcuccacuggcugcccagg

SEQ ID NO: 7403 - RNA, 22 nt, Artificial Sequence
  Synthetic
caggcuccacuggcugcccagg

SEQ ID NO: 7404 - RNA, 23 nt, Artificial Sequence
  Synthetic
acaggcuccacuggcugcccagg

SEQ ID NO: 7405 - RNA, 24 nt, Artificial Sequence
  Synthetic
cacaggcuccacuggcugcccagg

SEQ ID NO: 7406 - RNA, 18 nt, Artificial Sequence
  Synthetic
ggaggggaggaugccagg

SEQ ID NO: 7407 - RNA, 19 nt, Artificial Sequence
  Synthetic
aggaggggaggaugccagg

SEQ ID NO: 7408 - RNA, 20 nt, Artificial Sequence
  Synthetic
aaggaggggaggaugccagg

SEQ ID NO: 7409 - RNA, 21 nt, Artificial Sequence
  Synthetic
gaaggaggggaggaugccagg

SEQ ID NO: 7410 - RNA, 22 nt, Artificial Sequence
  Synthetic
ggaaggaggggaggaugccagg

SEQ ID NO: 7411 - RNA, 23 nt, Artificial Sequence
  Synthetic
gggaaggaggggaggaugccagg

SEQ ID NO: 7412 - RNA, 24 nt, Artificial Sequence
  Synthetic
ugggaaggaggggaggaugccagg

SEQ ID NO: 7413 - RNA, 18 nt, Artificial Sequence
  Synthetic
caggguggcauaggcagg

SEQ ID NO: 7414 - RNA, 19 nt, Artificial Sequence
  Synthetic
ccaggguggcauaggcagg

SEQ ID NO: 7415 - RNA, 21 nt, Artificial Sequence
  Synthetic
gcccaggguggcauaggcagg

SEQ ID NO: 7416 - RNA, 22 nt, Artificial Sequence
  Synthetic
ggcccaggguggcauaggcagg

SEQ ID NO: 7417 - RNA, 23 nt, Artificial Sequence
  Synthetic
gggcccaggguggcauaggcagg

SEQ ID NO: 7418 - RNA, 24 nt, Artificial Sequence
  Synthetic
ggggcccaggguggcauaggcagg

SEQ ID NO: 7419 - RNA, 18 nt, Artificial Sequence
  Synthetic
auggaagacauccagagg

SEQ ID NO: 7420 - RNA, 19 nt, Artificial Sequence
  Synthetic
cauggaagacauccagagg

SEQ ID NO: 7421 - RNA, 20 nt, Artificial Sequence
  Synthetic
gcauggaagacauccagagg

SEQ ID NO: 7422 - RNA, 21 nt, Artificial Sequence
  Synthetic
ggcauggaagacauccagagg

SEQ ID NO: 7423 - RNA, 22 nt, Artificial Sequence
  Synthetic
aggcauggaagacauccagagg

SEQ ID NO: 7424 - RNA, 23 nt, Artificial Sequence
  Synthetic
caggcauggaagacauccagagg

SEQ ID NO: 7425 - RNA, 24 nt, Artificial Sequence
  Synthetic
ccaggcauggaagacauccagagg

SEQ ID NO: 7426 - RNA, 18 nt, Artificial Sequence
  Synthetic
uuagguguggggcagagg

SEQ ID NO: 7427 - RNA, 19 nt, Artificial Sequence
  Synthetic
cuuagguguggggcagagg

SEQ ID NO: 7428 - RNA, 20 nt, Artificial Sequence
  Synthetic
ucuuagguguggggcagagg

SEQ ID NO: 7429 - RNA, 21 nt, Artificial Sequence
  Synthetic
uucuuagguguggggcagagg

SEQ ID NO: 7430 - RNA, 22 nt, Artificial Sequence
  Synthetic
uuucuuagguguggggcagagg

SEQ ID NO: 7431 - RNA, 23 nt, Artificial Sequence
  Synthetic
auuucuuagguguggggcagagg

SEQ ID NO: 7432 - RNA, 24 nt, Artificial Sequence
  Synthetic
cauuucuuagguguggggcagagg

SEQ ID NO: 7433 - RNA, 18 nt, Artificial Sequence
  Synthetic
caccuggaagggaggagg

SEQ ID NO: 7434 - RNA, 19 nt, Artificial Sequence
  Synthetic
acaccuggaagggaggagg

SEQ ID NO: 7435 - RNA, 20 nt, Artificial Sequence
  Synthetic
cacaccuggaagggaggagg

SEQ ID NO: 7436 - RNA, 21 nt, Artificial Sequence
  Synthetic
acacaccuggaagggaggagg

SEQ ID NO: 7437 - RNA, 22 nt, Artificial Sequence
  Synthetic
uacacaccuggaagggaggagg

SEQ ID NO: 7438 - RNA, 23 nt, Artificial Sequence
  Synthetic
auacacaccuggaagggaggagg

SEQ ID NO: 7439 - RNA, 24 nt, Artificial Sequence
  Synthetic
aauacacaccuggaagggaggagg

SEQ ID NO: 7440 - RNA, 18 nt, Artificial Sequence
  Synthetic
ucgacgggccccgugagg

SEQ ID NO: 7441 - RNA, 19 nt, Artificial Sequence
  Synthetic
cucgacgggccccgugagg

SEQ ID NO: 7442 - RNA, 21 nt, Artificial Sequence
  Synthetic
ggcucgacgggccccgugagg

SEQ ID NO: 7443 - RNA, 22 nt, Artificial Sequence
  Synthetic
gggcucgacgggccccgugagg

SEQ ID NO: 7444 - RNA, 23 nt, Artificial Sequence
  Synthetic
cgggcucgacgggccccgugagg

SEQ ID NO: 7445 - RNA, 24 nt, Artificial Sequence
  Synthetic
acgggcucgacgggccccgugagg

SEQ ID NO: 7446 - RNA, 18 nt, Artificial Sequence
  Synthetic
ggcccaggguggcauagg

SEQ ID NO: 7447 - RNA, 19 nt, Artificial Sequence
  Synthetic
gggcccaggguggcauagg

SEQ ID NO: 7448 - RNA, 20 nt, Artificial Sequence
  Synthetic
ggggcccaggguggcauagg

SEQ ID NO: 7449 - RNA, 21 nt, Artificial Sequence
  Synthetic
gggggcccaggguggcauagg

SEQ ID NO: 7450 - RNA, 22 nt, Artificial Sequence
  Synthetic
cgggggcccaggguggcauagg

SEQ ID NO: 7451 - RNA, 23 nt, Artificial Sequence
  Synthetic
gcgggggcccaggguggcauagg

SEQ ID NO: 7452 - RNA, 24 nt, Artificial Sequence
  Synthetic
ggcgggggcccaggguggcauagg

SEQ ID NO: 7453 - RNA, 18 nt, Artificial Sequence
  Synthetic
aauacacaccuggaaggg

SEQ ID NO: 7454 - RNA, 19 nt, Artificial Sequence
  Synthetic
gaauacacaccuggaaggg

SEQ ID NO: 7455 - RNA, 21 nt, Artificial Sequence
  Synthetic
gugaauacacaccuggaaggg

SEQ ID NO: 7456 - RNA, 22 nt, Artificial Sequence
  Synthetic
agugaauacacaccuggaaggg

SEQ ID NO: 7457 - RNA, 23 nt, Artificial Sequence
  Synthetic
gagugaauacacaccuggaaggg

SEQ ID NO: 7458 - RNA, 24 nt, Artificial Sequence
  Synthetic
ggagugaauacacaccuggaaggg

SEQ ID NO: 7459 - RNA, 18 nt, Artificial Sequence
  Synthetic
uuccggguaccugaaggg

SEQ ID NO: 7460 - RNA, 19 nt, Artificial Sequence
  Synthetic
uuuccggguaccugaaggg

SEQ ID NO: 7461 - RNA, 20 nt, Artificial Sequence
  Synthetic
auuuccggguaccugaaggg

SEQ ID NO: 7462 - RNA, 21 nt, Artificial Sequence
  Synthetic
aauuuccggguaccugaaggg

SEQ ID NO: 7463 - RNA, 22 nt, Artificial Sequence
  Synthetic
uaauuuccggguaccugaaggg

SEQ ID NO: 7464 - RNA, 23 nt, Artificial Sequence
  Synthetic
uuaauuuccggguaccugaaggg

SEQ ID NO: 7465 - RNA, 24 nt, Artificial Sequence
  Synthetic
uuuaauuuccggguaccugaaggg

SEQ ID NO: 7466 - RNA, 18 nt, Artificial Sequence
  Synthetic
uuguggcugggaccaggg

SEQ ID NO: 7467 - RNA, 19 nt, Artificial Sequence
  Synthetic
cuuguggcugggaccaggg

SEQ ID NO: 7468 - RNA, 20 nt, Artificial Sequence
  Synthetic
ucuuguggcugggaccaggg

SEQ ID NO: 7469 - RNA, 18 nt, Artificial Sequence
  Synthetic
gaggggaggaugccaggg

SEQ ID NO: 7470 - RNA, 19 nt, Artificial Sequence
  Synthetic
ggaggggaggaugccaggg

SEQ ID NO: 7471 - RNA, 21 nt, Artificial Sequence
  Synthetic
aaggaggggaggaugccaggg

SEQ ID NO: 7472 - RNA, 22 nt, Artificial Sequence
  Synthetic
gaaggaggggaggaugccaggg

SEQ ID NO: 7473 - RNA, 23 nt, Artificial Sequence
  Synthetic
ggaaggaggggaggaugccaggg

SEQ ID NO: 7474 - RNA, 24 nt, Artificial Sequence
  Synthetic
gggaaggaggggaggaugccaggg

SEQ ID NO: 7475 - RNA, 18 nt, Artificial Sequence
  Synthetic
uagguguggggcagaggg

SEQ ID NO: 7476 - RNA, 19 nt, Artificial Sequence
  Synthetic
uuagguguggggcagaggg

SEQ ID NO: 7477 - RNA, 21 nt, Artificial Sequence
  Synthetic
ucuuagguguggggcagaggg

SEQ ID NO: 7478 - RNA, 22 nt, Artificial Sequence
  Synthetic
uucuuagguguggggcagaggg

SEQ ID NO: 7479 - RNA, 23 nt, Artificial Sequence
  Synthetic
uuucuuagguguggggcagaggg

SEQ ID NO: 7480 - RNA, 24 nt, Artificial Sequence
  Synthetic
auuucuuagguguggggcagaggg

SEQ ID NO: 7481 - RNA, 18 nt, Artificial Sequence
  Synthetic
accuggaagggaggaggg

SEQ ID NO: 7482 - RNA, 19 nt, Artificial Sequence
  Synthetic
caccuggaagggaggaggg

SEQ ID NO: 7483 - RNA, 21 nt, Artificial Sequence
  Synthetic
cacaccuggaagggaggaggg

SEQ ID NO: 7484 - RNA, 22 nt, Artificial Sequence
  Synthetic
acacaccuggaagggaggaggg

SEQ ID NO: 7485 - RNA, 23 nt, Artificial Sequence
  Synthetic
uacacaccuggaagggaggaggg

SEQ ID NO: 7486 - RNA, 24 nt, Artificial Sequence
  Synthetic
auacacaccuggaagggaggaggg

SEQ ID NO: 7487 - RNA, 18 nt, Artificial Sequence
  Synthetic
ggguggcauaggcagggg

SEQ ID NO: 7488 - RNA, 19 nt, Artificial Sequence
  Synthetic
aggguggcauaggcagggg

SEQ ID NO: 7489 - RNA, 20 nt, Artificial Sequence
  Synthetic
caggguggcauaggcagggg

SEQ ID NO: 7490 - RNA, 21 nt, Artificial Sequence
  Synthetic
ccaggguggcauaggcagggg

SEQ ID NO: 7491 - RNA, 22 nt, Artificial Sequence
  Synthetic
cccaggguggcauaggcagggg

SEQ ID NO: 7492 - RNA, 23 nt, Artificial Sequence
  Synthetic
gcccaggguggcauaggcagggg

SEQ ID NO: 7493 - RNA, 24 nt, Artificial Sequence
  Synthetic
ggcccaggguggcauaggcagggg

SEQ ID NO: 7494 - RNA, 18 nt, Artificial Sequence
  Synthetic
accugaaggggcgagggg

SEQ ID NO: 7495 - RNA, 19 nt, Artificial Sequence
  Synthetic
uaccugaaggggcgagggg

SEQ ID NO: 7496 - RNA, 20 nt, Artificial Sequence
  Synthetic
guaccugaaggggcgagggg

SEQ ID NO: 7497 - RNA, 21 nt, Artificial Sequence
  Synthetic
gguaccugaaggggcgagggg

SEQ ID NO: 7498 - RNA, 22 nt, Artificial Sequence
  Synthetic
ggguaccugaaggggcgagggg

SEQ ID NO: 7499 - RNA, 23 nt, Artificial Sequence
  Synthetic
cggguaccugaaggggcgagggg

SEQ ID NO: 7500 - RNA, 24 nt, Artificial Sequence
  Synthetic
ccggguaccugaaggggcgagggg

SEQ ID NO: 7501 - RNA, 18 nt, Artificial Sequence
  Synthetic
gggccccgugaggcgggg

SEQ ID NO: 7502 - RNA, 19 nt, Artificial Sequence
  Synthetic
cgggccccgugaggcgggg

SEQ ID NO: 7503 - RNA, 20 nt, Artificial Sequence
  Synthetic
acgggccccgugaggcgggg

SEQ ID NO: 7504 - RNA, 21 nt, Artificial Sequence
  Synthetic
gacgggccccgugaggcgggg

SEQ ID NO: 7505 - RNA, 22 nt, Artificial Sequence
  Synthetic
cgacgggccccgugaggcgggg

SEQ ID NO: 7506 - RNA, 23 nt, Artificial Sequence
  Synthetic
ucgacgggccccgugaggcgggg

SEQ ID NO: 7507 - RNA, 24 nt, Artificial Sequence
  Synthetic
cucgacgggccccgugaggcgggg

SEQ ID NO: 7508 - RNA, 18 nt, Artificial Sequence
  Synthetic
gguggcauaggcaggggg

SEQ ID NO: 7509 - RNA, 19 nt, Artificial Sequence
  Synthetic
ggguggcauaggcaggggg

SEQ ID NO: 7510 - RNA, 21 nt, Artificial Sequence
  Synthetic
caggguggcauaggcaggggg

SEQ ID NO: 7511 - RNA, 22 nt, Artificial Sequence
  Synthetic
ccaggguggcauaggcaggggg

SEQ ID NO: 7512 - RNA, 23 nt, Artificial Sequence
  Synthetic
cccaggguggcauaggcaggggg

SEQ ID NO: 7513 - RNA, 24 nt, Artificial Sequence
  Synthetic
gcccaggguggcauaggcaggggg

SEQ ID NO: 7514 - RNA, 18 nt, Artificial Sequence
  Synthetic
ggccccgugaggcggggg

SEQ ID NO: 7515 - RNA, 19 nt, Artificial Sequence
  Synthetic
gggccccgugaggcggggg

SEQ ID NO: 7516 - RNA, 21 nt, Artificial Sequence
  Synthetic
acgggccccgugaggcggggg

SEQ ID NO: 7517 - RNA, 22 nt, Artificial Sequence
  Synthetic
gacgggccccgugaggcggggg

SEQ ID NO: 7518 - RNA, 23 nt, Artificial Sequence
  Synthetic
cgacgggccccgugaggcggggg

SEQ ID NO: 7519 - RNA, 24 nt, Artificial Sequence
  Synthetic
ucgacgggccccgugaggcggggg

SEQ ID NO: 7520 - RNA, 18 nt, Artificial Sequence
  Synthetic
agagacaugggguggggg

SEQ ID NO: 7521 - RNA, 19 nt, Artificial Sequence
  Synthetic
cagagacaugggguggggg

SEQ ID NO: 7522 - RNA, 20 nt, Artificial Sequence
  Synthetic
acagagacaugggguggggg

SEQ ID NO: 7523 - RNA, 21 nt, Artificial Sequence
  Synthetic
gacagagacaugggguggggg

SEQ ID NO: 7524 - RNA, 22 nt, Artificial Sequence
  Synthetic
ggacagagacaugggguggggg

SEQ ID NO: 7525 - RNA, 23 nt, Artificial Sequence
  Synthetic
aggacagagacaugggguggggg

SEQ ID NO: 7526 - RNA, 24 nt, Artificial Sequence
  Synthetic
aaggacagagacaugggguggggg

SEQ ID NO: 7527 - RNA, 18 nt, Artificial Sequence
  Synthetic
aaggacagagacaugggg

SEQ ID NO: 7528 - RNA, 19 nt, Artificial Sequence
  Synthetic
caaggacagagacaugggg

SEQ ID NO: 7529 - RNA, 21 nt, Artificial Sequence
  Synthetic
gacaaggacagagacaugggg

SEQ ID NO: 7530 - RNA, 22 nt, Artificial Sequence
  Synthetic
ggacaaggacagagacaugggg

SEQ ID NO: 7531 - RNA, 23 nt, Artificial Sequence
  Synthetic
gggacaaggacagagacaugggg

SEQ ID NO: 7532 - RNA, 24 nt, Artificial Sequence
  Synthetic
ugggacaaggacagagacaugggg

SEQ ID NO: 7533 - RNA, 18 nt, Artificial Sequence
  Synthetic
uagcuggucacgcugggg

SEQ ID NO: 7534 - RNA, 19 nt, Artificial Sequence
  Synthetic
guagcuggucacgcugggg

SEQ ID NO: 7535 - RNA, 20 nt, Artificial Sequence
  Synthetic
gguagcuggucacgcugggg

SEQ ID NO: 7536 - RNA, 21 nt, Artificial Sequence
  Synthetic
ugguagcuggucacgcugggg

SEQ ID NO: 7537 - RNA, 22 nt, Artificial Sequence
  Synthetic
cugguagcuggucacgcugggg

SEQ ID NO: 7538 - RNA, 23 nt, Artificial Sequence
  Synthetic
gcugguagcuggucacgcugggg

SEQ ID NO: 7539 - RNA, 24 nt, Artificial Sequence
  Synthetic
agcugguagcuggucacgcugggg

SEQ ID NO: 7540 - RNA, 18 nt, Artificial Sequence
  Synthetic
cauuucuuaggugugggg

SEQ ID NO: 7541 - RNA, 19 nt, Artificial Sequence
  Synthetic
ccauuucuuaggugugggg

SEQ ID NO: 7542 - RNA, 20 nt, Artificial Sequence
  Synthetic
uccauuucuuaggugugggg

SEQ ID NO: 7543 - RNA, 21 nt, Artificial Sequence
  Synthetic
cuccauuucuuaggugugggg

SEQ ID NO: 7544 - RNA, 22 nt, Artificial Sequence
  Synthetic
acuccauuucuuaggugugggg

SEQ ID NO: 7545 - RNA, 23 nt, Artificial Sequence
  Synthetic
cacuccauuucuuaggugugggg

SEQ ID NO: 7546 - RNA, 24 nt, Artificial Sequence
  Synthetic
ccacuccauuucuuaggugugggg

SEQ ID NO: 7547 - RNA, 18 nt, Artificial Sequence
  Synthetic
caaggacagagacauggg

SEQ ID NO: 7548 - RNA, 19 nt, Artificial Sequence
  Synthetic
acaaggacagagacauggg

SEQ ID NO: 7549 - RNA, 20 nt, Artificial Sequence
  Synthetic
gacaaggacagagacauggg

SEQ ID NO: 7550 - RNA, 21 nt, Artificial Sequence
  Synthetic
ggacaaggacagagacauggg

SEQ ID NO: 7551 - RNA, 22 nt, Artificial Sequence
  Synthetic
gggacaaggacagagacauggg

SEQ ID NO: 7552 - RNA, 23 nt, Artificial Sequence
  Synthetic
ugggacaaggacagagacauggg

SEQ ID NO: 7553 - RNA, 24 nt, Artificial Sequence
  Synthetic
cugggacaaggacagagacauggg

SEQ ID NO: 7554 - RNA, 18 nt, Artificial Sequence
  Synthetic
gagcccccuggagauggg

SEQ ID NO: 7555 - RNA, 19 nt, Artificial Sequence
  Synthetic
agagcccccuggagauggg

SEQ ID NO: 7556 - RNA, 21 nt, Artificial Sequence
  Synthetic
gcagagcccccuggagauggg

SEQ ID NO: 7557 - RNA, 22 nt, Artificial Sequence
  Synthetic
ugcagagcccccuggagauggg

SEQ ID NO: 7558 - RNA, 23 nt, Artificial Sequence
  Synthetic
cugcagagcccccuggagauggg

SEQ ID NO: 7559 - RNA, 24 nt, Artificial Sequence
  Synthetic
ccugcagagcccccuggagauggg

SEQ ID NO: 7560 - RNA, 18 nt, Artificial Sequence
  Synthetic
ggugggggcagaaguggg

SEQ ID NO: 7561 - RNA, 19 nt, Artificial Sequence
  Synthetic
gggugggggcagaaguggg

SEQ ID NO: 7562 - RNA, 20 nt, Artificial Sequence
  Synthetic
ggggugggggcagaaguggg

SEQ ID NO: 7563 - RNA, 21 nt, Artificial Sequence
  Synthetic
uggggugggggcagaaguggg

SEQ ID NO: 7564 - RNA, 22 nt, Artificial Sequence
  Synthetic
auggggugggggcagaaguggg

SEQ ID NO: 7565 - RNA, 23 nt, Artificial Sequence
  Synthetic
cauggggugggggcagaaguggg

SEQ ID NO: 7566 - RNA, 24 nt, Artificial Sequence
  Synthetic
acauggggugggggcagaaguggg

SEQ ID NO: 7567 - RNA, 18 nt, Artificial Sequence
  Synthetic
uguggggcagaggguggg

SEQ ID NO: 7568 - RNA, 19 nt, Artificial Sequence
  Synthetic
guguggggcagaggguggg

SEQ ID NO: 7569 - RNA, 20 nt, Artificial Sequence
  Synthetic
gguguggggcagaggguggg

SEQ ID NO: 7570 - RNA, 21 nt, Artificial Sequence
  Synthetic
agguguggggcagaggguggg

SEQ ID NO: 7571 - RNA, 22 nt, Artificial Sequence
  Synthetic
uagguguggggcagaggguggg

SEQ ID NO: 7572 - RNA, 23 nt, Artificial Sequence
  Synthetic
uuagguguggggcagaggguggg

SEQ ID NO: 7573 - RNA, 24 nt, Artificial Sequence
  Synthetic
cuuagguguggggcagaggguggg

SEQ ID NO: 7574 - RNA, 18 nt, Artificial Sequence
  Synthetic
agagcccccuggagaugg

SEQ ID NO: 7575 - RNA, 19 nt, Artificial Sequence
  Synthetic
cagagcccccuggagaugg

SEQ ID NO: 7576 - RNA, 20 nt, Artificial Sequence
  Synthetic
gcagagcccccuggagaugg

SEQ ID NO: 7577 - RNA, 21 nt, Artificial Sequence
  Synthetic
ugcagagcccccuggagaugg

SEQ ID NO: 7578 - RNA, 22 nt, Artificial Sequence
  Synthetic
cugcagagcccccuggagaugg

SEQ ID NO: 7579 - RNA, 23 nt, Artificial Sequence
  Synthetic
ccugcagagcccccuggagaugg

SEQ ID NO: 7580 - RNA, 24 nt, Artificial Sequence
  Synthetic
cccugcagagcccccuggagaugg

SEQ ID NO: 7581 - RNA, 18 nt, Artificial Sequence
  Synthetic
gagugaauacacaccugg

SEQ ID NO: 7582 - RNA, 19 nt, Artificial Sequence
  Synthetic
ggagugaauacacaccugg

SEQ ID NO: 7583 - RNA, 20 nt, Artificial Sequence
  Synthetic
aggagugaauacacaccugg

SEQ ID NO: 7584 - RNA, 21 nt, Artificial Sequence
  Synthetic
caggagugaauacacaccugg

SEQ ID NO: 7585 - RNA, 22 nt, Artificial Sequence
  Synthetic
gcaggagugaauacacaccugg

SEQ ID NO: 7586 - RNA, 23 nt, Artificial Sequence
  Synthetic
agcaggagugaauacacaccugg

SEQ ID NO: 7587 - RNA, 24 nt, Artificial Sequence
  Synthetic
aagcaggagugaauacacaccugg

SEQ ID NO: 7588 - RNA, 18 nt, Artificial Sequence
  Synthetic
ugguugcaggagaccugg

SEQ ID NO: 7589 - RNA, 19 nt, Artificial Sequence
  Synthetic
cugguugcaggagaccugg

SEQ ID NO: 7590 - RNA, 20 nt, Artificial Sequence
  Synthetic
ccugguugcaggagaccugg

SEQ ID NO: 7591 - RNA, 21 nt, Artificial Sequence
  Synthetic
gccugguugcaggagaccugg

SEQ ID NO: 7592 - RNA, 22 nt, Artificial Sequence
  Synthetic
cgccugguugcaggagaccugg

SEQ ID NO: 7593 - RNA, 23 nt, Artificial Sequence
  Synthetic
acgccugguugcaggagaccugg

SEQ ID NO: 7594 - RNA, 24 nt, Artificial Sequence
  Synthetic
cacgccugguugcaggagaccugg

SEQ ID NO: 7595 - RNA, 18 nt, Artificial Sequence
  Synthetic
agagggagcagggccugg

SEQ ID NO: 7596 - RNA, 19 nt, Artificial Sequence
  Synthetic
gagagggagcagggccugg

SEQ ID NO: 7597 - RNA, 20 nt, Artificial Sequence
  Synthetic
ggagagggagcagggccugg

SEQ ID NO: 7598 - RNA, 21 nt, Artificial Sequence
  Synthetic
uggagagggagcagggccugg

SEQ ID NO: 7599 - RNA, 22 nt, Artificial Sequence
  Synthetic
cuggagagggagcagggccugg

SEQ ID NO: 7600 - RNA, 23 nt, Artificial Sequence
  Synthetic
gcuggagagggagcagggccugg

SEQ ID NO: 7601 - RNA, 24 nt, Artificial Sequence
  Synthetic
ggcuggagagggagcagggccugg

SEQ ID NO: 7602 - RNA, 18 nt, Artificial Sequence
  Synthetic
ccugaugaguaugucugg

SEQ ID NO: 7603 - RNA, 19 nt, Artificial Sequence
  Synthetic
cccugaugaguaugucugg

SEQ ID NO: 7604 - RNA, 20 nt, Artificial Sequence
  Synthetic
ccccugaugaguaugucugg

SEQ ID NO: 7605 - RNA, 21 nt, Artificial Sequence
  Synthetic
accccugaugaguaugucugg

SEQ ID NO: 7606 - RNA, 22 nt, Artificial Sequence
  Synthetic
caccccugaugaguaugucugg

SEQ ID NO: 7607 - RNA, 23 nt, Artificial Sequence
  Synthetic
ccaccccugaugaguaugucugg

SEQ ID NO: 7608 - RNA, 24 nt, Artificial Sequence
  Synthetic
uccaccccugaugaguaugucugg

SEQ ID NO: 7609 - RNA, 18 nt, Artificial Sequence
  Synthetic
cccccagaggacaggugg

SEQ ID NO: 7610 - RNA, 19 nt, Artificial Sequence
  Synthetic
ccccccagaggacaggugg

SEQ ID NO: 7611 - RNA, 21 nt, Artificial Sequence
  Synthetic
gcccccccagaggacaggugg

SEQ ID NO: 7612 - RNA, 22 nt, Artificial Sequence
  Synthetic
ggcccccccagaggacaggugg

SEQ ID NO: 7613 - RNA, 23 nt, Artificial Sequence
  Synthetic
gggcccccccagaggacaggugg

SEQ ID NO: 7614 - RNA, 24 nt, Artificial Sequence
  Synthetic
agggcccccccagaggacaggugg

SEQ ID NO: 7615 - RNA, 18 nt, Artificial Sequence
  Synthetic
uuuccauacaucgggugg

SEQ ID NO: 7616 - RNA, 19 nt, Artificial Sequence
  Synthetic
guuuccauacaucgggugg

SEQ ID NO: 7617 - RNA, 21 nt, Artificial Sequence
  Synthetic
caguuuccauacaucgggugg

SEQ ID NO: 7618 - RNA, 22 nt, Artificial Sequence
  Synthetic
gcaguuuccauacaucgggugg

SEQ ID NO: 7619 - RNA, 23 nt, Artificial Sequence
  Synthetic
agcaguuuccauacaucgggugg

SEQ ID NO: 7620 - RNA, 24 nt, Artificial Sequence
  Synthetic
uagcaguuuccauacaucgggugg

SEQ ID NO: 7621 - RNA, 18 nt, Artificial Sequence
  Synthetic
aaccuucggagcagcaug

SEQ ID NO: 7622 - RNA, 19 nt, Artificial Sequence
  Synthetic
gaaccuucggagcagcaug

SEQ ID NO: 7623 - RNA, 21 nt, Artificial Sequence
  Synthetic
cggaaccuucggagcagcaug

SEQ ID NO: 7624 - RNA, 22 nt, Artificial Sequence
  Synthetic
ucggaaccuucggagcagcaug

SEQ ID NO: 7625 - RNA, 23 nt, Artificial Sequence
  Synthetic
uucggaaccuucggagcagcaug

SEQ ID NO: 7626 - RNA, 24 nt, Artificial Sequence
  Synthetic
cuucggaaccuucggagcagcaug

SEQ ID NO: 7627 - RNA, 18 nt, Artificial Sequence
  Synthetic
cuggucacgcuggggaug

SEQ ID NO: 7628 - RNA, 19 nt, Artificial Sequence
  Synthetic
gcuggucacgcuggggaug

SEQ ID NO: 7629 - RNA, 20 nt, Artificial Sequence
  Synthetic
agcuggucacgcuggggaug

SEQ ID NO: 7630 - RNA, 21 nt, Artificial Sequence
  Synthetic
uagcuggucacgcuggggaug

SEQ ID NO: 7631 - RNA, 22 nt, Artificial Sequence
  Synthetic
guagcuggucacgcuggggaug

SEQ ID NO: 7632 - RNA, 23 nt, Artificial Sequence
  Synthetic
gguagcuggucacgcuggggaug

SEQ ID NO: 7633 - RNA, 24 nt, Artificial Sequence
  Synthetic
ugguagcuggucacgcuggggaug

SEQ ID NO: 7634 - RNA, 18 nt, Artificial Sequence
  Synthetic
uuaauuuccggguaccug

SEQ ID NO: 7635 - RNA, 19 nt, Artificial Sequence
  Synthetic
uuuaauuuccggguaccug

SEQ ID NO: 7636 - RNA, 20 nt, Artificial Sequence
  Synthetic
cuuuaauuuccggguaccug

SEQ ID NO: 7637 - RNA, 21 nt, Artificial Sequence
  Synthetic
ucuuuaauuuccggguaccug

SEQ ID NO: 7638 - RNA, 22 nt, Artificial Sequence
  Synthetic
cucuuuaauuuccggguaccug

SEQ ID NO: 7639 - RNA, 23 nt, Artificial Sequence
  Synthetic
ccucuuuaauuuccggguaccug

SEQ ID NO: 7640 - RNA, 24 nt, Artificial Sequence
  Synthetic
uccucuuuaauuuccggguaccug

SEQ ID NO: 7641 - RNA, 18 nt, Artificial Sequence
  Synthetic
uggaggaacuggccccug

SEQ ID NO: 7642 - RNA, 19 nt, Artificial Sequence
  Synthetic
guggaggaacuggccccug

SEQ ID NO: 7643 - RNA, 20 nt, Artificial Sequence
  Synthetic
gguggaggaacuggccccug

SEQ ID NO: 7644 - RNA, 21 nt, Artificial Sequence
  Synthetic
agguggaggaacuggccccug

SEQ ID NO: 7645 - RNA, 22 nt, Artificial Sequence
  Synthetic
cagguggaggaacuggccccug

SEQ ID NO: 7646 - RNA, 23 nt, Artificial Sequence
  Synthetic
acagguggaggaacuggccccug

SEQ ID NO: 7647 - RNA, 24 nt, Artificial Sequence
  Synthetic
gacagguggaggaacuggccccug

SEQ ID NO: 7648 - RNA, 18 nt, Artificial Sequence
  Synthetic
gaggggcugucaaggcug

SEQ ID NO: 7649 - RNA, 19 nt, Artificial Sequence
  Synthetic
ggaggggcugucaaggcug

SEQ ID NO: 7650 - RNA, 20 nt, Artificial Sequence
  Synthetic
gggaggggcugucaaggcug

SEQ ID NO: 7651 - RNA, 21 nt, Artificial Sequence
  Synthetic
ggggaggggcugucaaggcug

SEQ ID NO: 7652 - RNA, 22 nt, Artificial Sequence
  Synthetic
gggggaggggcugucaaggcug

SEQ ID NO: 7653 - RNA, 23 nt, Artificial Sequence
  Synthetic
agggggaggggcugucaaggcug

SEQ ID NO: 7654 - RNA, 24 nt, Artificial Sequence
  Synthetic
cagggggaggggcugucaaggcug

SEQ ID NO: 7655 - RNA, 18 nt, Artificial Sequence
  Synthetic
cgcaggucgcgacggcug

SEQ ID NO: 7656 - RNA, 19 nt, Artificial Sequence
  Synthetic
ccgcaggucgcgacggcug

SEQ ID NO: 7657 - RNA, 21 nt, Artificial Sequence
  Synthetic
ccccgcaggucgcgacggcug

SEQ ID NO: 7658 - RNA, 22 nt, Artificial Sequence
  Synthetic
cccccgcaggucgcgacggcug

SEQ ID NO: 7659 - RNA, 23 nt, Artificial Sequence
  Synthetic
ucccccgcaggucgcgacggcug

SEQ ID NO: 7660 - RNA, 24 nt, Artificial Sequence
  Synthetic
gucccccgcaggucgcgacggcug

SEQ ID NO: 7661 - RNA, 18 nt, Artificial Sequence
  Synthetic
cuugccuuccucaugcug

SEQ ID NO: 7662 - RNA, 19 nt, Artificial Sequence
  Synthetic
ccuugccuuccucaugcug

SEQ ID NO: 7663 - RNA, 20 nt, Artificial Sequence
  Synthetic
uccuugccuuccucaugcug

SEQ ID NO: 7664 - RNA, 21 nt, Artificial Sequence
  Synthetic
auccuugccuuccucaugcug

SEQ ID NO: 7665 - RNA, 22 nt, Artificial Sequence
  Synthetic
cauccuugccuuccucaugcug

SEQ ID NO: 7666 - RNA, 23 nt, Artificial Sequence
  Synthetic
gcauccuugccuuccucaugcug

SEQ ID NO: 7667 - RNA, 24 nt, Artificial Sequence
  Synthetic
agcauccuugccuuccucaugcug

SEQ ID NO: 7668 - RNA, 18 nt, Artificial Sequence
  Synthetic
aacagcccagguggucug

SEQ ID NO: 7669 - RNA, 19 nt, Artificial Sequence
  Synthetic
aaacagcccagguggucug

SEQ ID NO: 7670 - RNA, 21 nt, Artificial Sequence
  Synthetic
ugaaacagcccagguggucug

SEQ ID NO: 7671 - RNA, 22 nt, Artificial Sequence
  Synthetic
gugaaacagcccagguggucug

SEQ ID NO: 7672 - RNA, 23 nt, Artificial Sequence
  Synthetic
ggugaaacagcccagguggucug

SEQ ID NO: 7673 - RNA, 24 nt, Artificial Sequence
  Synthetic
uggugaaacagcccagguggucug

SEQ ID NO: 7674 - RNA, 18 nt, Artificial Sequence
  Synthetic
gagccggccacgagagug

SEQ ID NO: 7675 - RNA, 19 nt, Artificial Sequence
  Synthetic
ggagccggccacgagagug

SEQ ID NO: 7676 - RNA, 20 nt, Artificial Sequence
  Synthetic
gggagccggccacgagagug

SEQ ID NO: 7677 - RNA, 21 nt, Artificial Sequence
  Synthetic
cgggagccggccacgagagug

SEQ ID NO: 7678 - RNA, 22 nt, Artificial Sequence
  Synthetic
gcgggagccggccacgagagug

SEQ ID NO: 7679 - RNA, 23 nt, Artificial Sequence
  Synthetic
ugcgggagccggccacgagagug

SEQ ID NO: 7680 - RNA, 24 nt, Artificial Sequence
  Synthetic
cugcgggagccggccacgagagug

SEQ ID NO: 7681 - RNA, 18 nt, Artificial Sequence
  Synthetic
ccccccagaggacaggug

SEQ ID NO: 7682 - RNA, 19 nt, Artificial Sequence
  Synthetic
cccccccagaggacaggug

SEQ ID NO: 7683 - RNA, 20 nt, Artificial Sequence
  Synthetic
gcccccccagaggacaggug

SEQ ID NO: 7684 - RNA, 21 nt, Artificial Sequence
  Synthetic
ggcccccccagaggacaggug

SEQ ID NO: 7685 - RNA, 22 nt, Artificial Sequence
  Synthetic
gggcccccccagaggacaggug

SEQ ID NO: 7686 - RNA, 23 nt, Artificial Sequence
  Synthetic
agggcccccccagaggacaggug

SEQ ID NO: 7687 - RNA, 24 nt, Artificial Sequence
  Synthetic
cagggcccccccagaggacaggug

SEQ ID NO: 7688 - RNA, 18 nt, Artificial Sequence
  Synthetic
cacuccauuucuuaggug

SEQ ID NO: 7689 - RNA, 19 nt, Artificial Sequence
  Synthetic
ccacuccauuucuuaggug

SEQ ID NO: 7690 - RNA, 21 nt, Artificial Sequence
  Synthetic
ggccacuccauuucuuaggug

SEQ ID NO: 7691 - RNA, 22 nt, Artificial Sequence
  Synthetic
uggccacuccauuucuuaggug

SEQ ID NO: 7692 - RNA, 23 nt, Artificial Sequence
  Synthetic
uuggccacuccauuucuuaggug

SEQ ID NO: 7693 - RNA, 24 nt, Artificial Sequence
  Synthetic
uuuggccacuccauuucuuaggug

SEQ ID NO: 7694 - RNA, 18 nt, Artificial Sequence
  Synthetic
cuggaagggaggagggug

SEQ ID NO: 7695 - RNA, 19 nt, Artificial Sequence
  Synthetic
ccuggaagggaggagggug

SEQ ID NO: 7696 - RNA, 20 nt, Artificial Sequence
  Synthetic
accuggaagggaggagggug

SEQ ID NO: 7697 - RNA, 21 nt, Artificial Sequence
  Synthetic
caccuggaagggaggagggug

SEQ ID NO: 7698 - RNA, 22 nt, Artificial Sequence
  Synthetic
acaccuggaagggaggagggug

SEQ ID NO: 7699 - RNA, 23 nt, Artificial Sequence
  Synthetic
cacaccuggaagggaggagggug

SEQ ID NO: 7700 - RNA, 24 nt, Artificial Sequence
  Synthetic
acacaccuggaagggaggagggug

SEQ ID NO: 7701 - RNA, 18 nt, Artificial Sequence
  Synthetic
guuuccauacaucgggug

SEQ ID NO: 7702 - RNA, 19 nt, Artificial Sequence
  Synthetic
aguuuccauacaucgggug

SEQ ID NO: 7703 - RNA, 20 nt, Artificial Sequence
  Synthetic
caguuuccauacaucgggug

SEQ ID NO: 7704 - RNA, 21 nt, Artificial Sequence
  Synthetic
gcaguuuccauacaucgggug

SEQ ID NO: 7705 - RNA, 22 nt, Artificial Sequence
  Synthetic
agcaguuuccauacaucgggug

SEQ ID NO: 7706 - RNA, 23 nt, Artificial Sequence
  Synthetic
uagcaguuuccauacaucgggug

SEQ ID NO: 7707 - RNA, 24 nt, Artificial Sequence
  Synthetic
auagcaguuuccauacaucgggug

SEQ ID NO: 7708 - RNA, 18 nt, Artificial Sequence
  Synthetic
gggacagaccuaggggug

SEQ ID NO: 7709 - RNA, 19 nt, Artificial Sequence
  Synthetic
agggacagaccuaggggug

SEQ ID NO: 7710 - RNA, 20 nt, Artificial Sequence
  Synthetic
cagggacagaccuaggggug

SEQ ID NO: 7711 - RNA, 21 nt, Artificial Sequence
  Synthetic
ucagggacagaccuaggggug

SEQ ID NO: 7712 - RNA, 22 nt, Artificial Sequence
  Synthetic
aucagggacagaccuaggggug

SEQ ID NO: 7713 - RNA, 23 nt, Artificial Sequence
  Synthetic
caucagggacagaccuaggggug

SEQ ID NO: 7714 - RNA, 24 nt, Artificial Sequence
  Synthetic
gcaucagggacagaccuaggggug

SEQ ID NO: 7715 - RNA, 18 nt, Artificial Sequence
  Synthetic
ccggccacgagaguggug

SEQ ID NO: 7716 - RNA, 19 nt, Artificial Sequence
  Synthetic
gccggccacgagaguggug

SEQ ID NO: 7717 - RNA, 20 nt, Artificial Sequence
  Synthetic
agccggccacgagaguggug

SEQ ID NO: 7718 - RNA, 21 nt, Artificial Sequence
  Synthetic
gagccggccacgagaguggug

SEQ ID NO: 7719 - RNA, 22 nt, Artificial Sequence
  Synthetic
ggagccggccacgagaguggug

SEQ ID NO: 7720 - RNA, 23 nt, Artificial Sequence
  Synthetic
gggagccggccacgagaguggug

SEQ ID NO: 7721 - RNA, 24 nt, Artificial Sequence
  Synthetic
cgggagccggccacgagaguggug

SEQ ID NO: 7722 - RNA, 18 nt, Artificial Sequence
  Synthetic
cauggcuuccggcacuug

SEQ ID NO: 7723 - RNA, 19 nt, Artificial Sequence
  Synthetic
gcauggcuuccggcacuug

SEQ ID NO: 7724 - RNA, 20 nt, Artificial Sequence
  Synthetic
ugcauggcuuccggcacuug

SEQ ID NO: 7725 - RNA, 21 nt, Artificial Sequence
  Synthetic
cugcauggcuuccggcacuug

SEQ ID NO: 7726 - RNA, 22 nt, Artificial Sequence
  Synthetic
ccugcauggcuuccggcacuug

SEQ ID NO: 7727 - RNA, 23 nt, Artificial Sequence
  Synthetic
accugcauggcuuccggcacuug

SEQ ID NO: 7728 - RNA, 24 nt, Artificial Sequence
  Synthetic
aaccugcauggcuuccggcacuug

SEQ ID NO: 7729 - RNA, 18 nt, Artificial Sequence
  Synthetic
uuguaguucagcuccuug

SEQ ID NO: 7730 - RNA, 19 nt, Artificial Sequence
  Synthetic
uuuguaguucagcuccuug

SEQ ID NO: 7731 - RNA, 20 nt, Artificial Sequence
  Synthetic
uuuuguaguucagcuccuug

SEQ ID NO: 7732 - RNA, 21 nt, Artificial Sequence
  Synthetic
guuuuguaguucagcuccuug

SEQ ID NO: 7733 - RNA, 22 nt, Artificial Sequence
  Synthetic
gguuuuguaguucagcuccuug

SEQ ID NO: 7734 - RNA, 23 nt, Artificial Sequence
  Synthetic
ugguuuuguaguucagcuccuug

SEQ ID NO: 7735 - RNA, 24 nt, Artificial Sequence
  Synthetic
uugguuuuguaguucagcuccuug

SEQ ID NO: 7736 - RNA, 18 nt, Artificial Sequence
  Synthetic
cugacucacgccugguug

SEQ ID NO: 7737 - RNA, 19 nt, Artificial Sequence
  Synthetic
acugacucacgccugguug

SEQ ID NO: 7738 - RNA, 20 nt, Artificial Sequence
  Synthetic
gacugacucacgccugguug

SEQ ID NO: 7739 - RNA, 21 nt, Artificial Sequence
  Synthetic
ggacugacucacgccugguug

SEQ ID NO: 7740 - RNA, 22 nt, Artificial Sequence
  Synthetic
aggacugacucacgccugguug

SEQ ID NO: 7741 - RNA, 23 nt, Artificial Sequence
  Synthetic
caggacugacucacgccugguug

SEQ ID NO: 7742 - RNA, 24 nt, Artificial Sequence
  Synthetic
gcaggacugacucacgccugguug

SEQ ID NO: 7743 - RNA, 18 nt, Artificial Sequence
  Synthetic
gaaccuucggagcagcau

SEQ ID NO: 7744 - RNA, 19 nt, Artificial Sequence
  Synthetic
ggaaccuucggagcagcau

SEQ ID NO: 7745 - RNA, 20 nt, Artificial Sequence
  Synthetic
cggaaccuucggagcagcau

SEQ ID NO: 7746 - RNA, 21 nt, Artificial Sequence
  Synthetic
ucggaaccuucggagcagcau

SEQ ID NO: 7747 - RNA, 22 nt, Artificial Sequence
  Synthetic
uucggaaccuucggagcagcau

SEQ ID NO: 7748 - RNA, 23 nt, Artificial Sequence
  Synthetic
cuucggaaccuucggagcagcau

SEQ ID NO: 7749 - RNA, 24 nt, Artificial Sequence
  Synthetic
gcuucggaaccuucggagcagcau

SEQ ID NO: 7750 - RNA, 18 nt, Artificial Sequence
  Synthetic
cugcucugcgcgcagcau

SEQ ID NO: 7751 - RNA, 19 nt, Artificial Sequence
  Synthetic
ucugcucugcgcgcagcau

SEQ ID NO: 7752 - RNA, 20 nt, Artificial Sequence
  Synthetic
uucugcucugcgcgcagcau

SEQ ID NO: 7753 - RNA, 21 nt, Artificial Sequence
  Synthetic
auucugcucugcgcgcagcau

SEQ ID NO: 7754 - RNA, 22 nt, Artificial Sequence
  Synthetic
cauucugcucugcgcgcagcau

SEQ ID NO: 7755 - RNA, 23 nt, Artificial Sequence
  Synthetic
ucauucugcucugcgcgcagcau

SEQ ID NO: 7756 - RNA, 24 nt, Artificial Sequence
  Synthetic
gucauucugcucugcgcgcagcau

SEQ ID NO: 7757 - RNA, 18 nt, Artificial Sequence
  Synthetic
guucugucgcgauagcau

SEQ ID NO: 7758 - RNA, 19 nt, Artificial Sequence
  Synthetic
uguucugucgcgauagcau

SEQ ID NO: 7759 - RNA, 20 nt, Artificial Sequence
  Synthetic
uuguucugucgcgauagcau

SEQ ID NO: 7760 - RNA, 21 nt, Artificial Sequence
  Synthetic
auuguucugucgcgauagcau

SEQ ID NO: 7761 - RNA, 22 nt, Artificial Sequence
  Synthetic
aauuguucugucgcgauagcau

SEQ ID NO: 7762 - RNA, 23 nt, Artificial Sequence
  Synthetic
uaauuguucugucgcgauagcau

SEQ ID NO: 7763 - RNA, 24 nt, Artificial Sequence
  Synthetic
guaauuguucugucgcgauagcau

SEQ ID NO: 7764 - RNA, 18 nt, Artificial Sequence
  Synthetic
gugagaguaauuccuuau

SEQ ID NO: 7765 - RNA, 19 nt, Artificial Sequence
  Synthetic
agugagaguaauuccuuau

SEQ ID NO: 7766 - RNA, 20 nt, Artificial Sequence
  Synthetic
aagugagaguaauuccuuau

SEQ ID NO: 7767 - RNA, 21 nt, Artificial Sequence
  Synthetic
gaagugagaguaauuccuuau

SEQ ID NO: 7768 - RNA, 22 nt, Artificial Sequence
  Synthetic
ggaagugagaguaauuccuuau

SEQ ID NO: 7769 - RNA, 23 nt, Artificial Sequence
  Synthetic
uggaagugagaguaauuccuuau

SEQ ID NO: 7770 - RNA, 24 nt, Artificial Sequence
  Synthetic
guggaagugagaguaauuccuuau

SEQ ID NO: 7771 - RNA, 18 nt, Artificial Sequence
  Synthetic
acccgggccccagucacu

SEQ ID NO: 7772 - RNA, 19 nt, Artificial Sequence
  Synthetic
uacccgggccccagucacu

SEQ ID NO: 7773 - RNA, 20 nt, Artificial Sequence
  Synthetic
uuacccgggccccagucacu

SEQ ID NO: 7774 - RNA, 21 nt, Artificial Sequence
  Synthetic
auuacccgggccccagucacu

SEQ ID NO: 7775 - RNA, 22 nt, Artificial Sequence
  Synthetic
cauuacccgggccccagucacu

SEQ ID NO: 7776 - RNA, 23 nt, Artificial Sequence
  Synthetic
ccauuacccgggccccagucacu

SEQ ID NO: 7777 - RNA, 24 nt, Artificial Sequence
  Synthetic
accauuacccgggccccagucacu

SEQ ID NO: 7778 - RNA, 18 nt, Artificial Sequence
  Synthetic
ucaccugcuguguguacu

SEQ ID NO: 7779 - RNA, 19 nt, Artificial Sequence
  Synthetic
cucaccugcuguguguacu

SEQ ID NO: 7780 - RNA, 20 nt, Artificial Sequence
  Synthetic
ccucaccugcuguguguacu

SEQ ID NO: 7781 - RNA, 21 nt, Artificial Sequence
  Synthetic
gccucaccugcuguguguacu

SEQ ID NO: 7782 - RNA, 22 nt, Artificial Sequence
  Synthetic
ggccucaccugcuguguguacu

SEQ ID NO: 7783 - RNA, 23 nt, Artificial Sequence
  Synthetic
gggccucaccugcuguguguacu

SEQ ID NO: 7784 - RNA, 24 nt, Artificial Sequence
  Synthetic
ugggccucaccugcuguguguacu

SEQ ID NO: 7785 - RNA, 18 nt, Artificial Sequence
  Synthetic
guaucggcuucggaaccu

SEQ ID NO: 7786 - RNA, 19 nt, Artificial Sequence
  Synthetic
aguaucggcuucggaaccu

SEQ ID NO: 7787 - RNA, 20 nt, Artificial Sequence
  Synthetic
caguaucggcuucggaaccu

SEQ ID NO: 7788 - RNA, 21 nt, Artificial Sequence
  Synthetic
ccaguaucggcuucggaaccu

SEQ ID NO: 7789 - RNA, 22 nt, Artificial Sequence
  Synthetic
accaguaucggcuucggaaccu

SEQ ID NO: 7790 - RNA, 23 nt, Artificial Sequence
  Synthetic
gaccaguaucggcuucggaaccu

SEQ ID NO: 7791 - RNA, 24 nt, Artificial Sequence
  Synthetic
agaccaguaucggcuucggaaccu

SEQ ID NO: 7792 - RNA, 18 nt, Artificial Sequence
  Synthetic
ucuggaagacccauuccu

SEQ ID NO: 7793 - RNA, 19 nt, Artificial Sequence
  Synthetic
aucuggaagacccauuccu

SEQ ID NO: 7794 - RNA, 21 nt, Artificial Sequence
  Synthetic
gcaucuggaagacccauuccu

SEQ ID NO: 7795 - RNA, 22 nt, Artificial Sequence
  Synthetic
agcaucuggaagacccauuccu

SEQ ID NO: 7796 - RNA, 23 nt, Artificial Sequence
  Synthetic
uagcaucuggaagacccauuccu

SEQ ID NO: 7797 - RNA, 24 nt, Artificial Sequence
  Synthetic
auagcaucuggaagacccauuccu

SEQ ID NO: 7798 - RNA, 18 nt, Artificial Sequence
  Synthetic
gucuguccaggguuuccu

SEQ ID NO: 7799 - RNA, 19 nt, Artificial Sequence
  Synthetic
agucuguccaggguuuccu

SEQ ID NO: 7800 - RNA, 20 nt, Artificial Sequence
  Synthetic
aagucuguccaggguuuccu

SEQ ID NO: 7801 - RNA, 21 nt, Artificial Sequence
  Synthetic
caagucuguccaggguuuccu

SEQ ID NO: 7802 - RNA, 22 nt, Artificial Sequence
  Synthetic
ccaagucuguccaggguuuccu

SEQ ID NO: 7803 - RNA, 23 nt, Artificial Sequence
  Synthetic
cccaagucuguccaggguuuccu

SEQ ID NO: 7804 - RNA, 24 nt, Artificial Sequence
  Synthetic
ccccaagucuguccaggguuuccu

SEQ ID NO: 7805 - RNA, 18 nt, Artificial Sequence
  Synthetic
caagcuggaggccacgcu

SEQ ID NO: 7806 - RNA, 19 nt, Artificial Sequence
  Synthetic
gcaagcuggaggccacgcu

SEQ ID NO: 7807 - RNA, 20 nt, Artificial Sequence
  Synthetic
cgcaagcuggaggccacgcu

SEQ ID NO: 7808 - RNA, 21 nt, Artificial Sequence
  Synthetic
ccgcaagcuggaggccacgcu

SEQ ID NO: 7809 - RNA, 22 nt, Artificial Sequence
  Synthetic
cccgcaagcuggaggccacgcu

SEQ ID NO: 7810 - RNA, 23 nt, Artificial Sequence
  Synthetic
ucccgcaagcuggaggccacgcu

SEQ ID NO: 7811 - RNA, 24 nt, Artificial Sequence
  Synthetic
gucccgcaagcuggaggccacgcu

SEQ ID NO: 7812 - RNA, 18 nt, Artificial Sequence
  Synthetic
ccgcaggucgcgacggcu

SEQ ID NO: 7813 - RNA, 19 nt, Artificial Sequence
  Synthetic
cccgcaggucgcgacggcu

SEQ ID NO: 7814 - RNA, 20 nt, Artificial Sequence
  Synthetic
ccccgcaggucgcgacggcu

SEQ ID NO: 7815 - RNA, 21 nt, Artificial Sequence
  Synthetic
cccccgcaggucgcgacggcu

SEQ ID NO: 7816 - RNA, 22 nt, Artificial Sequence
  Synthetic
ucccccgcaggucgcgacggcu

SEQ ID NO: 7817 - RNA, 23 nt, Artificial Sequence
  Synthetic
gucccccgcaggucgcgacggcu

SEQ ID NO: 7818 - RNA, 24 nt, Artificial Sequence
  Synthetic
agucccccgcaggucgcgacggcu

SEQ ID NO: 7819 - RNA, 18 nt, Artificial Sequence
  Synthetic
uggagaccaguaucggcu

SEQ ID NO: 7820 - RNA, 19 nt, Artificial Sequence
  Synthetic
cuggagaccaguaucggcu

SEQ ID NO: 7821 - RNA, 20 nt, Artificial Sequence
  Synthetic
ccuggagaccaguaucggcu

SEQ ID NO: 7822 - RNA, 21 nt, Artificial Sequence
  Synthetic
gccuggagaccaguaucggcu

SEQ ID NO: 7823 - RNA, 22 nt, Artificial Sequence
  Synthetic
ggccuggagaccaguaucggcu

SEQ ID NO: 7824 - RNA, 23 nt, Artificial Sequence
  Synthetic
cggccuggagaccaguaucggcu

SEQ ID NO: 7825 - RNA, 24 nt, Artificial Sequence
  Synthetic
ucggccuggagaccaguaucggcu

SEQ ID NO: 7826 - RNA, 18 nt, Artificial Sequence
  Synthetic
acaggagggugaccaucu

SEQ ID NO: 7827 - RNA, 19 nt, Artificial Sequence
  Synthetic
gacaggagggugaccaucu

SEQ ID NO: 7828 - RNA, 20 nt, Artificial Sequence
  Synthetic
ggacaggagggugaccaucu

SEQ ID NO: 7829 - RNA, 21 nt, Artificial Sequence
  Synthetic
uggacaggagggugaccaucu

SEQ ID NO: 7830 - RNA, 22 nt, Artificial Sequence
  Synthetic
uuggacaggagggugaccaucu

SEQ ID NO: 7831 - RNA, 23 nt, Artificial Sequence
  Synthetic
guuggacaggagggugaccaucu

SEQ ID NO: 7832 - RNA, 24 nt, Artificial Sequence
  Synthetic
gguuggacaggagggugaccaucu

SEQ ID NO: 7833 - RNA, 18 nt, Artificial Sequence
  Synthetic
aaaccucuccuucccucu

SEQ ID NO: 7834 - RNA, 19 nt, Artificial Sequence
  Synthetic
gaaaccucuccuucccucu

SEQ ID NO: 7835 - RNA, 20 nt, Artificial Sequence
  Synthetic
agaaaccucuccuucccucu

SEQ ID NO: 7836 - RNA, 21 nt, Artificial Sequence
  Synthetic
gagaaaccucuccuucccucu

SEQ ID NO: 7837 - RNA, 22 nt, Artificial Sequence
  Synthetic
ugagaaaccucuccuucccucu

SEQ ID NO: 7838 - RNA, 23 nt, Artificial Sequence
  Synthetic
gugagaaaccucuccuucccucu

SEQ ID NO: 7839 - RNA, 24 nt, Artificial Sequence
  Synthetic
ugugagaaaccucuccuucccucu

SEQ ID NO: 7840 - RNA, 18 nt, Artificial Sequence
  Synthetic
aaacagcccagguggucu

SEQ ID NO: 7841 - RNA, 19 nt, Artificial Sequence
  Synthetic
gaaacagcccagguggucu

SEQ ID NO: 7842 - RNA, 20 nt, Artificial Sequence
  Synthetic
ugaaacagcccagguggucu

SEQ ID NO: 7843 - RNA, 21 nt, Artificial Sequence
  Synthetic
gugaaacagcccagguggucu

SEQ ID NO: 7844 - RNA, 22 nt, Artificial Sequence
  Synthetic
ggugaaacagcccagguggucu

SEQ ID NO: 7845 - RNA, 23 nt, Artificial Sequence
  Synthetic
uggugaaacagcccagguggucu

SEQ ID NO: 7846 - RNA, 24 nt, Artificial Sequence
  Synthetic
uuggugaaacagcccagguggucu

SEQ ID NO: 7847 - RNA, 18 nt, Artificial Sequence
  Synthetic
uggggugggggcagaagu

SEQ ID NO: 7848 - RNA, 19 nt, Artificial Sequence
  Synthetic
auggggugggggcagaagu

SEQ ID NO: 7849 - RNA, 21 nt, Artificial Sequence
  Synthetic
acauggggugggggcagaagu

SEQ ID NO: 7850 - RNA, 22 nt, Artificial Sequence
  Synthetic
gacauggggugggggcagaagu

SEQ ID NO: 7851 - RNA, 23 nt, Artificial Sequence
  Synthetic
agacauggggugggggcagaagu

SEQ ID NO: 7852 - RNA, 24 nt, Artificial Sequence
  Synthetic
gagacauggggugggggcagaagu

SEQ ID NO: 7853 - RNA, 18 nt, Artificial Sequence
  Synthetic
ggacacagagacuagagu

SEQ ID NO: 7854 - RNA, 19 nt, Artificial Sequence
  Synthetic
uggacacagagacuagagu

SEQ ID NO: 7855 - RNA, 20 nt, Artificial Sequence
  Synthetic
cuggacacagagacuagagu

SEQ ID NO: 7856 - RNA, 21 nt, Artificial Sequence
  Synthetic
acuggacacagagacuagagu

SEQ ID NO: 7857 - RNA, 22 nt, Artificial Sequence
  Synthetic
cacuggacacagagacuagagu

SEQ ID NO: 7858 - RNA, 23 nt, Artificial Sequence
  Synthetic
gcacuggacacagagacuagagu

SEQ ID NO: 7859 - RNA, 24 nt, Artificial Sequence
  Synthetic
ugcacuggacacagagacuagagu

SEQ ID NO: 7860 - RNA, 18 nt, Artificial Sequence
  Synthetic
ccacuccauuucuuaggu

SEQ ID NO: 7861 - RNA, 19 nt, Artificial Sequence
  Synthetic
gccacuccauuucuuaggu

SEQ ID NO: 7862 - RNA, 20 nt, Artificial Sequence
  Synthetic
ggccacuccauuucuuaggu

SEQ ID NO: 7863 - RNA, 21 nt, Artificial Sequence
  Synthetic
uggccacuccauuucuuaggu

SEQ ID NO: 7864 - RNA, 22 nt, Artificial Sequence
  Synthetic
uuggccacuccauuucuuaggu

SEQ ID NO: 7865 - RNA, 23 nt, Artificial Sequence
  Synthetic
uuuggccacuccauuucuuaggu

SEQ ID NO: 7866 - RNA, 24 nt, Artificial Sequence
  Synthetic
cuuuggccacuccauuucuuaggu

SEQ ID NO: 7867 - RNA, 18 nt, Artificial Sequence
  Synthetic
agguguggggcagagggu

SEQ ID NO: 7868 - RNA, 19 nt, Artificial Sequence
  Synthetic
uagguguggggcagagggu

SEQ ID NO: 7869 - RNA, 21 nt, Artificial Sequence
  Synthetic
cuuagguguggggcagagggu

SEQ ID NO: 7870 - RNA, 22 nt, Artificial Sequence
  Synthetic
ucuuagguguggggcagagggu

SEQ ID NO: 7871 - RNA, 23 nt, Artificial Sequence
  Synthetic
uucuuagguguggggcagagggu

SEQ ID NO: 7872 - RNA, 24 nt, Artificial Sequence
  Synthetic
uuucuuagguguggggcagagggu

SEQ ID NO: 7873 - RNA, 18 nt, Artificial Sequence
  Synthetic
ggaaagagagaguagggu

SEQ ID NO: 7874 - RNA, 19 nt, Artificial Sequence
  Synthetic
aggaaagagagaguagggu

SEQ ID NO: 7875 - RNA, 20 nt, Artificial Sequence
  Synthetic
caggaaagagagaguagggu

SEQ ID NO: 7876 - RNA, 21 nt, Artificial Sequence
  Synthetic
ucaggaaagagagaguagggu

SEQ ID NO: 7877 - RNA, 22 nt, Artificial Sequence
  Synthetic
aucaggaaagagagaguagggu

SEQ ID NO: 7878 - RNA, 23 nt, Artificial Sequence
  Synthetic
uaucaggaaagagagaguagggu

SEQ ID NO: 7879 - RNA, 24 nt, Artificial Sequence
  Synthetic
uuaucaggaaagagagaguagggu

SEQ ID NO: 7880 - RNA, 18 nt, Artificial Sequence
  Synthetic
aggacagagacauggggu

SEQ ID NO: 7881 - RNA, 19 nt, Artificial Sequence
  Synthetic
aaggacagagacauggggu

SEQ ID NO: 7882 - RNA, 21 nt, Artificial Sequence
  Synthetic
acaaggacagagacauggggu

SEQ ID NO: 7883 - RNA, 22 nt, Artificial Sequence
  Synthetic
gacaaggacagagacauggggu

SEQ ID NO: 7884 - RNA, 23 nt, Artificial Sequence
  Synthetic
ggacaaggacagagacauggggu

SEQ ID NO: 7885 - RNA, 24 nt, Artificial Sequence
  Synthetic
gggacaaggacagagacauggggu

SEQ ID NO: 7886 - RNA, 18 nt, Artificial Sequence
  Synthetic
ugaaacagcccagguggu

SEQ ID NO: 7887 - RNA, 19 nt, Artificial Sequence
  Synthetic
gugaaacagcccagguggu

SEQ ID NO: 7888 - RNA, 20 nt, Artificial Sequence
  Synthetic
ggugaaacagcccagguggu

SEQ ID NO: 7889 - RNA, 21 nt, Artificial Sequence
  Synthetic
uggugaaacagcccagguggu

SEQ ID NO: 7890 - RNA, 22 nt, Artificial Sequence
  Synthetic
uuggugaaacagcccagguggu

SEQ ID NO: 7891 - RNA, 23 nt, Artificial Sequence
  Synthetic
cuuggugaaacagcccagguggu

SEQ ID NO: 7892 - RNA, 24 nt, Artificial Sequence
  Synthetic
acuuggugaaacagcccagguggu

SEQ ID NO: 7893 - RNA, 18 nt, Artificial Sequence
  Synthetic
aggagggugaccaucugu

SEQ ID NO: 7894 - RNA, 19 nt, Artificial Sequence
  Synthetic
caggagggugaccaucugu

SEQ ID NO: 7895 - RNA, 20 nt, Artificial Sequence
  Synthetic
acaggagggugaccaucugu

SEQ ID NO: 7896 - RNA, 21 nt, Artificial Sequence
  Synthetic
gacaggagggugaccaucugu

SEQ ID NO: 7897 - RNA, 22 nt, Artificial Sequence
  Synthetic
ggacaggagggugaccaucugu

SEQ ID NO: 7898 - RNA, 23 nt, Artificial Sequence
  Synthetic
uggacaggagggugaccaucugu

SEQ ID NO: 7899 - RNA, 24 nt, Artificial Sequence
  Synthetic
uuggacaggagggugaccaucugu

SEQ ID NO: 7900 - RNA, 18 nt, Artificial Sequence
  Synthetic
uaucggcuucggaaccuu

SEQ ID NO: 7901 - RNA, 19 nt, Artificial Sequence
  Synthetic
guaucggcuucggaaccuu

SEQ ID NO: 7902 - RNA, 21 nt, Artificial Sequence
  Synthetic
caguaucggcuucggaaccuu

SEQ ID NO: 7903 - RNA, 22 nt, Artificial Sequence
  Synthetic
ccaguaucggcuucggaaccuu

SEQ ID NO: 7904 - RNA, 23 nt, Artificial Sequence
  Synthetic
accaguaucggcuucggaaccuu

SEQ ID NO: 7905 - RNA, 24 nt, Artificial Sequence
  Synthetic
gaccaguaucggcuucggaaccuu

SEQ ID NO: 7906 - RNA, 18 nt, Artificial Sequence
  Synthetic
ggagaccaguaucggcuu

SEQ ID NO: 7907 - RNA, 19 nt, Artificial Sequence
  Synthetic
uggagaccaguaucggcuu

SEQ ID NO: 7908 - RNA, 21 nt, Artificial Sequence
  Synthetic
ccuggagaccaguaucggcuu

SEQ ID NO: 7909 - RNA, 22 nt, Artificial Sequence
  Synthetic
gccuggagaccaguaucggcuu

SEQ ID NO: 7910 - RNA, 23 nt, Artificial Sequence
  Synthetic
ggccuggagaccaguaucggcuu

SEQ ID NO: 7911 - RNA, 24 nt, Artificial Sequence
  Synthetic
cggccuggagaccaguaucggcuu

SEQ ID NO: 7912 - RNA, 18 nt, Artificial Sequence
  Synthetic
gucacaguacuccacguu

SEQ ID NO: 7913 - RNA, 19 nt, Artificial Sequence
  Synthetic
agucacaguacuccacguu

SEQ ID NO: 7914 - RNA, 20 nt, Artificial Sequence
  Synthetic
uagucacaguacuccacguu

SEQ ID NO: 7915 - RNA, 21 nt, Artificial Sequence
  Synthetic
guagucacaguacuccacguu

SEQ ID NO: 7916 - RNA, 22 nt, Artificial Sequence
  Synthetic
uguagucacaguacuccacguu

SEQ ID NO: 7917 - RNA, 23 nt, Artificial Sequence
  Synthetic
cuguagucacaguacuccacguu

SEQ ID NO: 7918 - RNA, 24 nt, Artificial Sequence
  Synthetic
ucuguagucacaguacuccacguu

SEQ ID NO: 7919 - RNA, 18 nt, Artificial Sequence
  Synthetic
cagugcaaccagaacaaa

SEQ ID NO: 7920 - RNA, 19 nt, Artificial Sequence
  Synthetic
ccagugcaaccagaacaaa

SEQ ID NO: 7921 - RNA, 20 nt, Artificial Sequence
  Synthetic
uccagugcaaccagaacaaa

SEQ ID NO: 7922 - RNA, 21 nt, Artificial Sequence
  Synthetic
guccagugcaaccagaacaaa

SEQ ID NO: 7923 - RNA, 22 nt, Artificial Sequence
  Synthetic
uguccagugcaaccagaacaaa

SEQ ID NO: 7924 - RNA, 23 nt, Artificial Sequence
  Synthetic
guguccagugcaaccagaacaaa

SEQ ID NO: 7925 - RNA, 24 nt, Artificial Sequence
  Synthetic
uguguccagugcaaccagaacaaa

SEQ ID NO: 7926 - RNA, 18 nt, Artificial Sequence
  Synthetic
agguacccggaaauuaaa

SEQ ID NO: 7927 - RNA, 19 nt, Artificial Sequence
  Synthetic
cagguacccggaaauuaaa

SEQ ID NO: 7928 - RNA, 20 nt, Artificial Sequence
  Synthetic
ucagguacccggaaauuaaa

SEQ ID NO: 7929 - RNA, 21 nt, Artificial Sequence
  Synthetic
uucagguacccggaaauuaaa

SEQ ID NO: 7930 - RNA, 22 nt, Artificial Sequence
  Synthetic
cuucagguacccggaaauuaaa

SEQ ID NO: 7931 - RNA, 23 nt, Artificial Sequence
  Synthetic
ccuucagguacccggaaauuaaa

SEQ ID NO: 7932 - RNA, 24 nt, Artificial Sequence
  Synthetic
cccuucagguacccggaaauuaaa

SEQ ID NO: 7933 - RNA, 18 nt, Artificial Sequence
  Synthetic
cugccccacaccuaagaa

SEQ ID NO: 7934 - RNA, 19 nt, Artificial Sequence
  Synthetic
ucugccccacaccuaagaa

SEQ ID NO: 7935 - RNA, 20 nt, Artificial Sequence
  Synthetic
cucugccccacaccuaagaa

SEQ ID NO: 7936 - RNA, 21 nt, Artificial Sequence
  Synthetic
ccucugccccacaccuaagaa

SEQ ID NO: 7937 - RNA, 22 nt, Artificial Sequence
  Synthetic
cccucugccccacaccuaagaa

SEQ ID NO: 7938 - RNA, 23 nt, Artificial Sequence
  Synthetic
acccucugccccacaccuaagaa

SEQ ID NO: 7939 - RNA, 24 nt, Artificial Sequence
  Synthetic
cacccucugccccacaccuaagaa

SEQ ID NO: 7940 - RNA, 18 nt, Artificial Sequence
  Synthetic
guccaaccugggcagcca

SEQ ID NO: 7941 - RNA, 19 nt, Artificial Sequence
  Synthetic
uguccaaccugggcagcca

SEQ ID NO: 7942 - RNA, 20 nt, Artificial Sequence
  Synthetic
cuguccaaccugggcagcca

SEQ ID NO: 7943 - RNA, 21 nt, Artificial Sequence
  Synthetic
ccuguccaaccugggcagcca

SEQ ID NO: 7944 - RNA, 22 nt, Artificial Sequence
  Synthetic
uccuguccaaccugggcagcca

SEQ ID NO: 7945 - RNA, 23 nt, Artificial Sequence
  Synthetic
cuccuguccaaccugggcagcca

SEQ ID NO: 7946 - RNA, 24 nt, Artificial Sequence
  Synthetic
ccuccuguccaaccugggcagcca

SEQ ID NO: 7947 - RNA, 18 nt, Artificial Sequence
  Synthetic
uccuggggugagacucca

SEQ ID NO: 7948 - RNA, 19 nt, Artificial Sequence
  Synthetic
uuccuggggugagacucca

SEQ ID NO: 7949 - RNA, 21 nt, Artificial Sequence
  Synthetic
aguuccuggggugagacucca

SEQ ID NO: 7950 - RNA, 22 nt, Artificial Sequence
  Synthetic
caguuccuggggugagacucca

SEQ ID NO: 7951 - RNA, 23 nt, Artificial Sequence
  Synthetic
acaguuccuggggugagacucca

SEQ ID NO: 7952 - RNA, 24 nt, Artificial Sequence
  Synthetic
cacaguuccuggggugagacucca

SEQ ID NO: 7953 - RNA, 18 nt, Artificial Sequence
  Synthetic
ggcccccgcccaucucca

SEQ ID NO: 7954 - RNA, 19 nt, Artificial Sequence
  Synthetic
gggcccccgcccaucucca

SEQ ID NO: 7955 - RNA, 21 nt, Artificial Sequence
  Synthetic
cugggcccccgcccaucucca

SEQ ID NO: 7956 - RNA, 22 nt, Artificial Sequence
  Synthetic
ccugggcccccgcccaucucca

SEQ ID NO: 7957 - RNA, 23 nt, Artificial Sequence
  Synthetic
cccugggcccccgcccaucucca

SEQ ID NO: 7958 - RNA, 24 nt, Artificial Sequence
  Synthetic
acccugggcccccgcccaucucca

SEQ ID NO: 7959 - RNA, 18 nt, Artificial Sequence
  Synthetic
aggagcuggaccgcauca

SEQ ID NO: 7960 - RNA, 19 nt, Artificial Sequence
  Synthetic
gaggagcuggaccgcauca

SEQ ID NO: 7961 - RNA, 20 nt, Artificial Sequence
  Synthetic
ggaggagcuggaccgcauca

SEQ ID NO: 7962 - RNA, 21 nt, Artificial Sequence
  Synthetic
uggaggagcuggaccgcauca

SEQ ID NO: 7963 - RNA, 22 nt, Artificial Sequence
  Synthetic
cuggaggagcuggaccgcauca

SEQ ID NO: 7964 - RNA, 23 nt, Artificial Sequence
  Synthetic
gcuggaggagcuggaccgcauca

SEQ ID NO: 7965 - RNA, 24 nt, Artificial Sequence
  Synthetic
agcuggaggagcuggaccgcauca

SEQ ID NO: 7966 - RNA, 18 nt, Artificial Sequence
  Synthetic
ggucccgcccccgccuca

SEQ ID NO: 7967 - RNA, 19 nt, Artificial Sequence
  Synthetic
gggucccgcccccgccuca

SEQ ID NO: 7968 - RNA, 21 nt, Artificial Sequence
  Synthetic
gagggucccgcccccgccuca

SEQ ID NO: 7969 - RNA, 22 nt, Artificial Sequence
  Synthetic
ugagggucccgcccccgccuca

SEQ ID NO: 7970 - RNA, 23 nt, Artificial Sequence
  Synthetic
cugagggucccgcccccgccuca

SEQ ID NO: 7971 - RNA, 24 nt, Artificial Sequence
  Synthetic
ccugagggucccgcccccgccuca

SEQ ID NO: 7972 - RNA, 18 nt, Artificial Sequence
  Synthetic
aagucaacaucuucuuca

SEQ ID NO: 7973 - RNA, 19 nt, Artificial Sequence
  Synthetic
aaagucaacaucuucuuca

SEQ ID NO: 7974 - RNA, 21 nt, Artificial Sequence
  Synthetic
ccaaagucaacaucuucuuca

SEQ ID NO: 7975 - RNA, 22 nt, Artificial Sequence
  Synthetic
gccaaagucaacaucuucuuca

SEQ ID NO: 7976 - RNA, 23 nt, Artificial Sequence
  Synthetic
ggccaaagucaacaucuucuuca

SEQ ID NO: 7977 - RNA, 24 nt, Artificial Sequence
  Synthetic
uggccaaagucaacaucuucuuca

SEQ ID NO: 7978 - RNA, 18 nt, Artificial Sequence
  Synthetic
uugguguauguggguuca

SEQ ID NO: 7979 - RNA, 19 nt, Artificial Sequence
  Synthetic
cuugguguauguggguuca

SEQ ID NO: 7980 - RNA, 20 nt, Artificial Sequence
  Synthetic
ucuugguguauguggguuca

SEQ ID NO: 7981 - RNA, 21 nt, Artificial Sequence
  Synthetic
cucuugguguauguggguuca

SEQ ID NO: 7982 - RNA, 22 nt, Artificial Sequence
  Synthetic
ucucuugguguauguggguuca

SEQ ID NO: 7983 - RNA, 23 nt, Artificial Sequence
  Synthetic
aucucuugguguauguggguuca

SEQ ID NO: 7984 - RNA, 24 nt, Artificial Sequence
  Synthetic
gaucucuugguguauguggguuca

SEQ ID NO: 7985 - RNA, 18 nt, Artificial Sequence
  Synthetic
ucugggggggcccugaga

SEQ ID NO: 7986 - RNA, 19 nt, Artificial Sequence
  Synthetic
cucugggggggcccugaga

SEQ ID NO: 7987 - RNA, 21 nt, Artificial Sequence
  Synthetic
uccucugggggggcccugaga

SEQ ID NO: 7988 - RNA, 22 nt, Artificial Sequence
  Synthetic
guccucugggggggcccugaga

SEQ ID NO: 7989 - RNA, 23 nt, Artificial Sequence
  Synthetic
uguccucugggggggcccugaga

SEQ ID NO: 7990 - RNA, 24 nt, Artificial Sequence
  Synthetic
cuguccucugggggggcccugaga

SEQ ID NO: 7991 - RNA, 18 nt, Artificial Sequence
  Synthetic
uacuggucuccaggccga

SEQ ID NO: 7992 - RNA, 19 nt, Artificial Sequence
  Synthetic
auacuggucuccaggccga

SEQ ID NO: 7993 - RNA, 21 nt, Artificial Sequence
  Synthetic
cgauacuggucuccaggccga

SEQ ID NO: 7994 - RNA, 22 nt, Artificial Sequence
  Synthetic
ccgauacuggucuccaggccga

SEQ ID NO: 7995 - RNA, 23 nt, Artificial Sequence
  Synthetic
gccgauacuggucuccaggccga

SEQ ID NO: 7996 - RNA, 24 nt, Artificial Sequence
  Synthetic
agccgauacuggucuccaggccga

SEQ ID NO: 7997 - RNA, 18 nt, Artificial Sequence
  Synthetic
uuccagaugcuaucgcga

SEQ ID NO: 7998 - RNA, 19 nt, Artificial Sequence
  Synthetic
cuuccagaugcuaucgcga

SEQ ID NO: 7999 - RNA, 20 nt, Artificial Sequence
  Synthetic
ucuuccagaugcuaucgcga

SEQ ID NO: 8000 - RNA, 21 nt, Artificial Sequence
  Synthetic
gucuuccagaugcuaucgcga

SEQ ID NO: 8001 - RNA, 22 nt, Artificial Sequence
  Synthetic
ggucuuccagaugcuaucgcga

SEQ ID NO: 8002 - RNA, 23 nt, Artificial Sequence
  Synthetic
gggucuuccagaugcuaucgcga

SEQ ID NO: 8003 - RNA, 24 nt, Artificial Sequence
  Synthetic
ugggucuuccagaugcuaucgcga

SEQ ID NO: 8004 - RNA, 18 nt, Artificial Sequence
  Synthetic
ccagguggacuggaagga

SEQ ID NO: 8005 - RNA, 19 nt, Artificial Sequence
  Synthetic
cccagguggacuggaagga

SEQ ID NO: 8006 - RNA, 20 nt, Artificial Sequence
  Synthetic
ccccagguggacuggaagga

SEQ ID NO: 8007 - RNA, 21 nt, Artificial Sequence
  Synthetic
cccccagguggacuggaagga

SEQ ID NO: 8008 - RNA, 22 nt, Artificial Sequence
  Synthetic
acccccagguggacuggaagga

SEQ ID NO: 8009 - RNA, 23 nt, Artificial Sequence
  Synthetic
aacccccagguggacuggaagga

SEQ ID NO: 8010 - RNA, 24 nt, Artificial Sequence
  Synthetic
caacccccagguggacuggaagga

SEQ ID NO: 8011 - RNA, 18 nt, Artificial Sequence
  Synthetic
ggggggcccugagaggga

SEQ ID NO: 8012 - RNA, 19 nt, Artificial Sequence
  Synthetic
gggggggcccugagaggga

SEQ ID NO: 8013 - RNA, 21 nt, Artificial Sequence
  Synthetic
cugggggggcccugagaggga

SEQ ID NO: 8014 - RNA, 22 nt, Artificial Sequence
  Synthetic
ucugggggggcccugagaggga

SEQ ID NO: 8015 - RNA, 23 nt, Artificial Sequence
  Synthetic
cucugggggggcccugagaggga

SEQ ID NO: 8016 - RNA, 24 nt, Artificial Sequence
  Synthetic
ccucugggggggcccugagaggga

SEQ ID NO: 8017 - RNA, 18 nt, Artificial Sequence
  Synthetic
cgguaggucgugccugga

SEQ ID NO: 8018 - RNA, 19 nt, Artificial Sequence
  Synthetic
acgguaggucgugccugga

SEQ ID NO: 8019 - RNA, 21 nt, Artificial Sequence
  Synthetic
ucacgguaggucgugccugga

SEQ ID NO: 8020 - RNA, 22 nt, Artificial Sequence
  Synthetic
gucacgguaggucgugccugga

SEQ ID NO: 8021 - RNA, 23 nt, Artificial Sequence
  Synthetic
ugucacgguaggucgugccugga

SEQ ID NO: 8022 - RNA, 24 nt, Artificial Sequence
  Synthetic
cugucacgguaggucgugccugga

SEQ ID NO: 8023 - RNA, 18 nt, Artificial Sequence
  Synthetic
caacaacccccaggugga

SEQ ID NO: 8024 - RNA, 19 nt, Artificial Sequence
  Synthetic
acaacaacccccaggugga

SEQ ID NO: 8025 - RNA, 20 nt, Artificial Sequence
  Synthetic
gacaacaacccccaggugga

SEQ ID NO: 8026 - RNA, 21 nt, Artificial Sequence
  Synthetic
ggacaacaacccccaggugga

SEQ ID NO: 8027 - RNA, 22 nt, Artificial Sequence
  Synthetic
gggacaacaacccccaggugga

SEQ ID NO: 8028 - RNA, 23 nt, Artificial Sequence
  Synthetic
cgggacaacaacccccaggugga

SEQ ID NO: 8029 - RNA, 24 nt, Artificial Sequence
  Synthetic
gcgggacaacaacccccaggugga

SEQ ID NO: 8030 - RNA, 18 nt, Artificial Sequence
  Synthetic
ccucugggggggcccuga

SEQ ID NO: 8031 - RNA, 19 nt, Artificial Sequence
  Synthetic
uccucugggggggcccuga

SEQ ID NO: 8032 - RNA, 20 nt, Artificial Sequence
  Synthetic
guccucugggggggcccuga

SEQ ID NO: 8033 - RNA, 21 nt, Artificial Sequence
  Synthetic
uguccucugggggggcccuga

SEQ ID NO: 8034 - RNA, 22 nt, Artificial Sequence
  Synthetic
cuguccucugggggggcccuga

SEQ ID NO: 8035 - RNA, 23 nt, Artificial Sequence
  Synthetic
ccuguccucugggggggcccuga

SEQ ID NO: 8036 - RNA, 24 nt, Artificial Sequence
  Synthetic
accuguccucugggggggcccuga

SEQ ID NO: 8037 - RNA, 18 nt, Artificial Sequence
  Synthetic
ggaaggcaaggaugcuga

SEQ ID NO: 8038 - RNA, 19 nt, Artificial Sequence
  Synthetic
aggaaggcaaggaugcuga

SEQ ID NO: 8039 - RNA, 20 nt, Artificial Sequence
  Synthetic
gaggaaggcaaggaugcuga

SEQ ID NO: 8040 - RNA, 21 nt, Artificial Sequence
  Synthetic
ugaggaaggcaaggaugcuga

SEQ ID NO: 8041 - RNA, 22 nt, Artificial Sequence
  Synthetic
augaggaaggcaaggaugcuga

SEQ ID NO: 8042 - RNA, 23 nt, Artificial Sequence
  Synthetic
caugaggaaggcaaggaugcuga

SEQ ID NO: 8043 - RNA, 24 nt, Artificial Sequence
  Synthetic
gcaugaggaaggcaaggaugcuga

SEQ ID NO: 8044 - RNA, 18 nt, Artificial Sequence
  Synthetic
cccugcuguccacaguga

SEQ ID NO: 8045 - RNA, 19 nt, Artificial Sequence
  Synthetic
ccccugcuguccacaguga

SEQ ID NO: 8046 - RNA, 20 nt, Artificial Sequence
  Synthetic
uccccugcuguccacaguga

SEQ ID NO: 8047 - RNA, 21 nt, Artificial Sequence
  Synthetic
uuccccugcuguccacaguga

SEQ ID NO: 8048 - RNA, 22 nt, Artificial Sequence
  Synthetic
auuccccugcuguccacaguga

SEQ ID NO: 8049 - RNA, 23 nt, Artificial Sequence
  Synthetic
cauuccccugcuguccacaguga

SEQ ID NO: 8050 - RNA, 24 nt, Artificial Sequence
  Synthetic
ucauuccccugcuguccacaguga

SEQ ID NO: 8051 - RNA, 18 nt, Artificial Sequence
  Synthetic
cguggaguacugugacua

SEQ ID NO: 8052 - RNA, 19 nt, Artificial Sequence
  Synthetic
acguggaguacugugacua

SEQ ID NO: 8053 - RNA, 20 nt, Artificial Sequence
  Synthetic
aacguggaguacugugacua

SEQ ID NO: 8054 - RNA, 21 nt, Artificial Sequence
  Synthetic
gaacguggaguacugugacua

SEQ ID NO: 8055 - RNA, 22 nt, Artificial Sequence
  Synthetic
agaacguggaguacugugacua

SEQ ID NO: 8056 - RNA, 23 nt, Artificial Sequence
  Synthetic
cagaacguggaguacugugacua

SEQ ID NO: 8057 - RNA, 24 nt, Artificial Sequence
  Synthetic
ccagaacguggaguacugugacua

SEQ ID NO: 8058 - RNA, 18 nt, Artificial Sequence
  Synthetic
cuuccaccacccgaugua

SEQ ID NO: 8059 - RNA, 19 nt, Artificial Sequence
  Synthetic
acuuccaccacccgaugua

SEQ ID NO: 8060 - RNA, 21 nt, Artificial Sequence
  Synthetic
ucacuuccaccacccgaugua

SEQ ID NO: 8061 - RNA, 22 nt, Artificial Sequence
  Synthetic
cucacuuccaccacccgaugua

SEQ ID NO: 8062 - RNA, 23 nt, Artificial Sequence
  Synthetic
ucucacuuccaccacccgaugua

SEQ ID NO: 8063 - RNA, 24 nt, Artificial Sequence
  Synthetic
cucucacuuccaccacccgaugua

SEQ ID NO: 8064 - RNA, 18 nt, Artificial Sequence
  Synthetic
ucagguacccggaaauua

SEQ ID NO: 8065 - RNA, 19 nt, Artificial Sequence
  Synthetic
uucagguacccggaaauua

SEQ ID NO: 8066 - RNA, 20 nt, Artificial Sequence
  Synthetic
cuucagguacccggaaauua

SEQ ID NO: 8067 - RNA, 21 nt, Artificial Sequence
  Synthetic
ccuucagguacccggaaauua

SEQ ID NO: 8068 - RNA, 22 nt, Artificial Sequence
  Synthetic
cccuucagguacccggaaauua

SEQ ID NO: 8069 - RNA, 23 nt, Artificial Sequence
  Synthetic
ccccuucagguacccggaaauua

SEQ ID NO: 8070 - RNA, 24 nt, Artificial Sequence
  Synthetic
gccccuucagguacccggaaauua

SEQ ID NO: 8071 - RNA, 18 nt, Artificial Sequence
  Synthetic
aauuacaccgucaacaac

SEQ ID NO: 8072 - RNA, 19 nt, Artificial Sequence
  Synthetic
caauuacaccgucaacaac

SEQ ID NO: 8073 - RNA, 20 nt, Artificial Sequence
  Synthetic
acaauuacaccgucaacaac

SEQ ID NO: 8074 - RNA, 21 nt, Artificial Sequence
  Synthetic
aacaauuacaccgucaacaac

SEQ ID NO: 8075 - RNA, 22 nt, Artificial Sequence
  Synthetic
gaacaauuacaccgucaacaac

SEQ ID NO: 8076 - RNA, 23 nt, Artificial Sequence
  Synthetic
agaacaauuacaccgucaacaac

SEQ ID NO: 8077 - RNA, 24 nt, Artificial Sequence
  Synthetic
cagaacaauuacaccgucaacaac

SEQ ID NO: 8078 - RNA, 18 nt, Artificial Sequence
  Synthetic
gucacccuccuguccaac

SEQ ID NO: 8079 - RNA, 19 nt, Artificial Sequence
  Synthetic
ggucacccuccuguccaac

SEQ ID NO: 8080 - RNA, 20 nt, Artificial Sequence
  Synthetic
uggucacccuccuguccaac

SEQ ID NO: 8081 - RNA, 21 nt, Artificial Sequence
  Synthetic
auggucacccuccuguccaac

SEQ ID NO: 8082 - RNA, 22 nt, Artificial Sequence
  Synthetic
gauggucacccuccuguccaac

SEQ ID NO: 8083 - RNA, 23 nt, Artificial Sequence
  Synthetic
agauggucacccuccuguccaac

SEQ ID NO: 8084 - RNA, 24 nt, Artificial Sequence
  Synthetic
cagauggucacccuccuguccaac

SEQ ID NO: 8085 - RNA, 18 nt, Artificial Sequence
  Synthetic
cucuguguccagugcaac

SEQ ID NO: 8086 - RNA, 19 nt, Artificial Sequence
  Synthetic
ucucuguguccagugcaac

SEQ ID NO: 8087 - RNA, 20 nt, Artificial Sequence
  Synthetic
gucucuguguccagugcaac

SEQ ID NO: 8088 - RNA, 21 nt, Artificial Sequence
  Synthetic
agucucuguguccagugcaac

SEQ ID NO: 8089 - RNA, 22 nt, Artificial Sequence
  Synthetic
uagucucuguguccagugcaac

SEQ ID NO: 8090 - RNA, 23 nt, Artificial Sequence
  Synthetic
cuagucucuguguccagugcaac

SEQ ID NO: 8091 - RNA, 24 nt, Artificial Sequence
  Synthetic
ucuagucucuguguccagugcaac

SEQ ID NO: 8092 - RNA, 18 nt, Artificial Sequence
  Synthetic
uauccgcggccccagaac

SEQ ID NO: 8093 - RNA, 19 nt, Artificial Sequence
  Synthetic
cuauccgcggccccagaac

SEQ ID NO: 8094 - RNA, 20 nt, Artificial Sequence
  Synthetic
ucuauccgcggccccagaac

SEQ ID NO: 8095 - RNA, 21 nt, Artificial Sequence
  Synthetic
uucuauccgcggccccagaac

SEQ ID NO: 8096 - RNA, 22 nt, Artificial Sequence
  Synthetic
cuucuauccgcggccccagaac

SEQ ID NO: 8097 - RNA, 23 nt, Artificial Sequence
  Synthetic
ucuucuauccgcggccccagaac

SEQ ID NO: 8098 - RNA, 24 nt, Artificial Sequence
  Synthetic
aucuucuauccgcggccccagaac

SEQ ID NO: 8099 - RNA, 18 nt, Artificial Sequence
  Synthetic
gacuucuccucagaccac

SEQ ID NO: 8100 - RNA, 19 nt, Artificial Sequence
  Synthetic
ugacuucuccucagaccac

SEQ ID NO: 8101 - RNA, 20 nt, Artificial Sequence
  Synthetic
uugacuucuccucagaccac

SEQ ID NO: 8102 - RNA, 21 nt, Artificial Sequence
  Synthetic
guugacuucuccucagaccac

SEQ ID NO: 8103 - RNA, 22 nt, Artificial Sequence
  Synthetic
gguugacuucuccucagaccac

SEQ ID NO: 8104 - RNA, 23 nt, Artificial Sequence
  Synthetic
agguugacuucuccucagaccac

SEQ ID NO: 8105 - RNA, 24 nt, Artificial Sequence
  Synthetic
cagguugacuucuccucagaccac

SEQ ID NO: 8106 - RNA, 18 nt, Artificial Sequence
  Synthetic
aggaaacccuggacagac

SEQ ID NO: 8107 - RNA, 19 nt, Artificial Sequence
  Synthetic
uaggaaacccuggacagac

SEQ ID NO: 8108 - RNA, 20 nt, Artificial Sequence
  Synthetic
auaggaaacccuggacagac

SEQ ID NO: 8109 - RNA, 21 nt, Artificial Sequence
  Synthetic
cauaggaaacccuggacagac

SEQ ID NO: 8110 - RNA, 22 nt, Artificial Sequence
  Synthetic
ucauaggaaacccuggacagac

SEQ ID NO: 8111 - RNA, 23 nt, Artificial Sequence
  Synthetic
uucauaggaaacccuggacagac

SEQ ID NO: 8112 - RNA, 24 nt, Artificial Sequence
  Synthetic
guucauaggaaacccuggacagac

SEQ ID NO: 8113 - RNA, 18 nt, Artificial Sequence
  Synthetic
cagguggacuggaaggac

SEQ ID NO: 8114 - RNA, 19 nt, Artificial Sequence
  Synthetic
ccagguggacuggaaggac

SEQ ID NO: 8115 - RNA, 21 nt, Artificial Sequence
  Synthetic
ccccagguggacuggaaggac

SEQ ID NO: 8116 - RNA, 22 nt, Artificial Sequence
  Synthetic
cccccagguggacuggaaggac

SEQ ID NO: 8117 - RNA, 23 nt, Artificial Sequence
  Synthetic
acccccagguggacuggaaggac

SEQ ID NO: 8118 - RNA, 24 nt, Artificial Sequence
  Synthetic
aacccccagguggacuggaaggac

SEQ ID NO: 8119 - RNA, 18 nt, Artificial Sequence
  Synthetic
aacaacccccagguggac

SEQ ID NO: 8120 - RNA, 19 nt, Artificial Sequence
  Synthetic
caacaacccccagguggac

SEQ ID NO: 8121 - RNA, 21 nt, Artificial Sequence
  Synthetic
gacaacaacccccagguggac

SEQ ID NO: 8122 - RNA, 22 nt, Artificial Sequence
  Synthetic
ggacaacaacccccagguggac

SEQ ID NO: 8123 - RNA, 23 nt, Artificial Sequence
  Synthetic
gggacaacaacccccagguggac

SEQ ID NO: 8124 - RNA, 24 nt, Artificial Sequence
  Synthetic
cgggacaacaacccccagguggac

SEQ ID NO: 8125 - RNA, 18 nt, Artificial Sequence
  Synthetic
ugcuauacuuucaaugac

SEQ ID NO: 8126 - RNA, 19 nt, Artificial Sequence
  Synthetic
cugcuauacuuucaaugac

SEQ ID NO: 8127 - RNA, 20 nt, Artificial Sequence
  Synthetic
acugcuauacuuucaaugac

SEQ ID NO: 8128 - RNA, 21 nt, Artificial Sequence
  Synthetic
aacugcuauacuuucaaugac

SEQ ID NO: 8129 - RNA, 22 nt, Artificial Sequence
  Synthetic
aaacugcuauacuuucaaugac

SEQ ID NO: 8130 - RNA, 23 nt, Artificial Sequence
  Synthetic
gaaacugcuauacuuucaaugac

SEQ ID NO: 8131 - RNA, 24 nt, Artificial Sequence
  Synthetic
ggaaacugcuauacuuucaaugac

SEQ ID NO: 8132 - RNA, 18 nt, Artificial Sequence
  Synthetic
gaaggcaaggaugcugac

SEQ ID NO: 8133 - RNA, 19 nt, Artificial Sequence
  Synthetic
ggaaggcaaggaugcugac

SEQ ID NO: 8134 - RNA, 21 nt, Artificial Sequence
  Synthetic
gaggaaggcaaggaugcugac

SEQ ID NO: 8135 - RNA, 22 nt, Artificial Sequence
  Synthetic
ugaggaaggcaaggaugcugac

SEQ ID NO: 8136 - RNA, 23 nt, Artificial Sequence
  Synthetic
augaggaaggcaaggaugcugac

SEQ ID NO: 8137 - RNA, 24 nt, Artificial Sequence
  Synthetic
caugaggaaggcaaggaugcugac

SEQ ID NO: 8138 - RNA, 18 nt, Artificial Sequence
  Synthetic
ccugcuguccacagugac

SEQ ID NO: 8139 - RNA, 19 nt, Artificial Sequence
  Synthetic
cccugcuguccacagugac

SEQ ID NO: 8140 - RNA, 21 nt, Artificial Sequence
  Synthetic
uccccugcuguccacagugac

SEQ ID NO: 8141 - RNA, 22 nt, Artificial Sequence
  Synthetic
uuccccugcuguccacagugac

SEQ ID NO: 8142 - RNA, 23 nt, Artificial Sequence
  Synthetic
auuccccugcuguccacagugac

SEQ ID NO: 8143 - RNA, 24 nt, Artificial Sequence
  Synthetic
cauuccccugcuguccacagugac

SEQ ID NO: 8144 - RNA, 18 nt, Artificial Sequence
  Synthetic
ccucgccccuucagguac

SEQ ID NO: 8145 - RNA, 19 nt, Artificial Sequence
  Synthetic
cccucgccccuucagguac

SEQ ID NO: 8146 - RNA, 20 nt, Artificial Sequence
  Synthetic
ccccucgccccuucagguac

SEQ ID NO: 8147 - RNA, 21 nt, Artificial Sequence
  Synthetic
uccccucgccccuucagguac

SEQ ID NO: 8148 - RNA, 22 nt, Artificial Sequence
  Synthetic
uuccccucgccccuucagguac

SEQ ID NO: 8149 - RNA, 23 nt, Artificial Sequence
  Synthetic
cuuccccucgccccuucagguac

SEQ ID NO: 8150 - RNA, 24 nt, Artificial Sequence
  Synthetic
ucuuccccucgccccuucagguac

SEQ ID NO: 8151 - RNA, 18 nt, Artificial Sequence
  Synthetic
guggguucauaggaaacc

SEQ ID NO: 8152 - RNA, 19 nt, Artificial Sequence
  Synthetic
uguggguucauaggaaacc

SEQ ID NO: 8153 - RNA, 20 nt, Artificial Sequence
  Synthetic
auguggguucauaggaaacc

SEQ ID NO: 8154 - RNA, 21 nt, Artificial Sequence
  Synthetic
uauguggguucauaggaaacc

SEQ ID NO: 8155 - RNA, 22 nt, Artificial Sequence
  Synthetic
guauguggguucauaggaaacc

SEQ ID NO: 8156 - RNA, 23 nt, Artificial Sequence
  Synthetic
uguauguggguucauaggaaacc

SEQ ID NO: 8157 - RNA, 24 nt, Artificial Sequence
  Synthetic
guguauguggguucauaggaaacc

SEQ ID NO: 8158 - RNA, 18 nt, Artificial Sequence
  Synthetic
cccccugccuaugccacc

SEQ ID NO: 8159 - RNA, 19 nt, Artificial Sequence
  Synthetic
ucccccugccuaugccacc

SEQ ID NO: 8160 - RNA, 20 nt, Artificial Sequence
  Synthetic
cucccccugccuaugccacc

SEQ ID NO: 8161 - RNA, 21 nt, Artificial Sequence
  Synthetic
ccucccccugccuaugccacc

SEQ ID NO: 8162 - RNA, 22 nt, Artificial Sequence
  Synthetic
cccucccccugccuaugccacc

SEQ ID NO: 8163 - RNA, 23 nt, Artificial Sequence
  Synthetic
ccccucccccugccuaugccacc

SEQ ID NO: 8164 - RNA, 24 nt, Artificial Sequence
  Synthetic
gccccucccccugccuaugccacc

SEQ ID NO: 8165 - RNA, 18 nt, Artificial Sequence
  Synthetic
cucgccccuucagguacc

SEQ ID NO: 8166 - RNA, 19 nt, Artificial Sequence
  Synthetic
ccucgccccuucagguacc

SEQ ID NO: 8167 - RNA, 21 nt, Artificial Sequence
  Synthetic
ccccucgccccuucagguacc

SEQ ID NO: 8168 - RNA, 22 nt, Artificial Sequence
  Synthetic
uccccucgccccuucagguacc

SEQ ID NO: 8169 - RNA, 23 nt, Artificial Sequence
  Synthetic
uuccccucgccccuucagguacc

SEQ ID NO: 8170 - RNA, 24 nt, Artificial Sequence
  Synthetic
cuuccccucgccccuucagguacc

SEQ ID NO: 8171 - RNA, 18 nt, Artificial Sequence
  Synthetic
aucuucuauccgcggccc

SEQ ID NO: 8172 - RNA, 19 nt, Artificial Sequence
  Synthetic
caucuucuauccgcggccc

SEQ ID NO: 8173 - RNA, 20 nt, Artificial Sequence
  Synthetic
acaucuucuauccgcggccc

SEQ ID NO: 8174 - RNA, 21 nt, Artificial Sequence
  Synthetic
uacaucuucuauccgcggccc

SEQ ID NO: 8175 - RNA, 22 nt, Artificial Sequence
  Synthetic
cuacaucuucuauccgcggccc

SEQ ID NO: 8176 - RNA, 23 nt, Artificial Sequence
  Synthetic
ccuacaucuucuauccgcggccc

SEQ ID NO: 8177 - RNA, 24 nt, Artificial Sequence
  Synthetic
gccuacaucuucuauccgcggccc

SEQ ID NO: 8178 - RNA, 18 nt, Artificial Sequence
  Synthetic
cagagacucugccauccc

SEQ ID NO: 8179 - RNA, 19 nt, Artificial Sequence
  Synthetic
ccagagacucugccauccc

SEQ ID NO: 8180 - RNA, 21 nt, Artificial Sequence
  Synthetic
ugccagagacucugccauccc

SEQ ID NO: 8181 - RNA, 22 nt, Artificial Sequence
  Synthetic
cugccagagacucugccauccc

SEQ ID NO: 8182 - RNA, 23 nt, Artificial Sequence
  Synthetic
gcugccagagacucugccauccc

SEQ ID NO: 8183 - RNA, 24 nt, Artificial Sequence
  Synthetic
ggcugccagagacucugccauccc

SEQ ID NO: 8184 - RNA, 18 nt, Artificial Sequence
  Synthetic
ggugaggcccgcagcgcc

SEQ ID NO: 8185 - RNA, 19 nt, Artificial Sequence
  Synthetic
uggugaggcccgcagcgcc

SEQ ID NO: 8186 - RNA, 20 nt, Artificial Sequence
  Synthetic
cuggugaggcccgcagcgcc

SEQ ID NO: 8187 - RNA, 21 nt, Artificial Sequence
  Synthetic
gcuggugaggcccgcagcgcc

SEQ ID NO: 8188 - RNA, 22 nt, Artificial Sequence
  Synthetic
agcuggugaggcccgcagcgcc

SEQ ID NO: 8189 - RNA, 23 nt, Artificial Sequence
  Synthetic
cagcuggugaggcccgcagcgcc

SEQ ID NO: 8190 - RNA, 24 nt, Artificial Sequence
  Synthetic
ccagcuggugaggcccgcagcgcc

SEQ ID NO: 8191 - RNA, 18 nt, Artificial Sequence
  Synthetic
gauacuggucuccaggcc

SEQ ID NO: 8192 - RNA, 19 nt, Artificial Sequence
  Synthetic
cgauacuggucuccaggcc

SEQ ID NO: 8193 - RNA, 20 nt, Artificial Sequence
  Synthetic
ccgauacuggucuccaggcc

SEQ ID NO: 8194 - RNA, 21 nt, Artificial Sequence
  Synthetic
gccgauacuggucuccaggcc

SEQ ID NO: 8195 - RNA, 22 nt, Artificial Sequence
  Synthetic
agccgauacuggucuccaggcc

SEQ ID NO: 8196 - RNA, 23 nt, Artificial Sequence
  Synthetic
aagccgauacuggucuccaggcc

SEQ ID NO: 8197 - RNA, 24 nt, Artificial Sequence
  Synthetic
gaagccgauacuggucuccaggcc

SEQ ID NO: 8198 - RNA, 18 nt, Artificial Sequence
  Synthetic
gaugcugacugggaggcc

SEQ ID NO: 8199 - RNA, 19 nt, Artificial Sequence
  Synthetic
ggaugcugacugggaggcc

SEQ ID NO: 8200 - RNA, 21 nt, Artificial Sequence
  Synthetic
aaggaugcugacugggaggcc

SEQ ID NO: 8201 - RNA, 22 nt, Artificial Sequence
  Synthetic
caaggaugcugacugggaggcc

SEQ ID NO: 8202 - RNA, 23 nt, Artificial Sequence
  Synthetic
gcaaggaugcugacugggaggcc

SEQ ID NO: 8203 - RNA, 24 nt, Artificial Sequence
  Synthetic
ggcaaggaugcugacugggaggcc

SEQ ID NO: 8204 - RNA, 18 nt, Artificial Sequence
  Synthetic
cuguccucugggggggcc

SEQ ID NO: 8205 - RNA, 19 nt, Artificial Sequence
  Synthetic
ccuguccucugggggggcc

SEQ ID NO: 8206 - RNA, 20 nt, Artificial Sequence
  Synthetic
accuguccucugggggggcc

SEQ ID NO: 8207 - RNA, 21 nt, Artificial Sequence
  Synthetic
caccuguccucugggggggcc

SEQ ID NO: 8208 - RNA, 22 nt, Artificial Sequence
  Synthetic
ccaccuguccucugggggggcc

SEQ ID NO: 8209 - RNA, 23 nt, Artificial Sequence
  Synthetic
uccaccuguccucugggggggcc

SEQ ID NO: 8210 - RNA, 24 nt, Artificial Sequence
  Synthetic
cuccaccuguccucugggggggcc

SEQ ID NO: 8211 - RNA, 18 nt, Artificial Sequence
  Synthetic
ccagagacucugccaucc

SEQ ID NO: 8212 - RNA, 19 nt, Artificial Sequence
  Synthetic
gccagagacucugccaucc

SEQ ID NO: 8213 - RNA, 20 nt, Artificial Sequence
  Synthetic
ugccagagacucugccaucc

SEQ ID NO: 8214 - RNA, 21 nt, Artificial Sequence
  Synthetic
cugccagagacucugccaucc

SEQ ID NO: 8215 - RNA, 22 nt, Artificial Sequence
  Synthetic
gcugccagagacucugccaucc

SEQ ID NO: 8216 - RNA, 23 nt, Artificial Sequence
  Synthetic
ggcugccagagacucugccaucc

SEQ ID NO: 8217 - RNA, 24 nt, Artificial Sequence
  Synthetic
aggcugccagagacucugccaucc

SEQ ID NO: 8218 - RNA, 18 nt, Artificial Sequence
  Synthetic
uuccuggggugagacucc

SEQ ID NO: 8219 - RNA, 19 nt, Artificial Sequence
  Synthetic
guuccuggggugagacucc

SEQ ID NO: 8220 - RNA, 21 nt, Artificial Sequence
  Synthetic
caguuccuggggugagacucc

SEQ ID NO: 8221 - RNA, 22 nt, Artificial Sequence
  Synthetic
acaguuccuggggugagacucc

SEQ ID NO: 8222 - RNA, 23 nt, Artificial Sequence
  Synthetic
cacaguuccuggggugagacucc

SEQ ID NO: 8223 - RNA, 24 nt, Artificial Sequence
  Synthetic
gcacaguuccuggggugagacucc

SEQ ID NO: 8224 - RNA, 18 nt, Artificial Sequence
  Synthetic
gggcccccgcccaucucc

SEQ ID NO: 8225 - RNA, 19 nt, Artificial Sequence
  Synthetic
ugggcccccgcccaucucc

SEQ ID NO: 8226 - RNA, 21 nt, Artificial Sequence
  Synthetic
ccugggcccccgcccaucucc

SEQ ID NO: 8227 - RNA, 22 nt, Artificial Sequence
  Synthetic
cccugggcccccgcccaucucc

SEQ ID NO: 8228 - RNA, 23 nt, Artificial Sequence
  Synthetic
acccugggcccccgcccaucucc

SEQ ID NO: 8229 - RNA, 24 nt, Artificial Sequence
  Synthetic
cacccugggcccccgcccaucucc

SEQ ID NO: 8230 - RNA, 18 nt, Artificial Sequence
  Synthetic
guauucacuccugcuucc

SEQ ID NO: 8231 - RNA, 19 nt, Artificial Sequence
  Synthetic
uguauucacuccugcuucc

SEQ ID NO: 8232 - RNA, 21 nt, Artificial Sequence
  Synthetic
uguguauucacuccugcuucc

SEQ ID NO: 8233 - RNA, 22 nt, Artificial Sequence
  Synthetic
guguguauucacuccugcuucc

SEQ ID NO: 8234 - RNA, 23 nt, Artificial Sequence
  Synthetic
gguguguauucacuccugcuucc

SEQ ID NO: 8235 - RNA, 24 nt, Artificial Sequence
  Synthetic
agguguguauucacuccugcuucc

SEQ ID NO: 8236 - RNA, 18 nt, Artificial Sequence
  Synthetic
gacacccccauucuuucc

SEQ ID NO: 8237 - RNA, 19 nt, Artificial Sequence
  Synthetic
ugacacccccauucuuucc

SEQ ID NO: 8238 - RNA, 20 nt, Artificial Sequence
  Synthetic
augacacccccauucuuucc

SEQ ID NO: 8239 - RNA, 21 nt, Artificial Sequence
  Synthetic
gaugacacccccauucuuucc

SEQ ID NO: 8240 - RNA, 22 nt, Artificial Sequence
  Synthetic
ugaugacacccccauucuuucc

SEQ ID NO: 8241 - RNA, 23 nt, Artificial Sequence
  Synthetic
uugaugacacccccauucuuucc

SEQ ID NO: 8242 - RNA, 24 nt, Artificial Sequence
  Synthetic
cuugaugacacccccauucuuucc

SEQ ID NO: 8243 - RNA, 18 nt, Artificial Sequence
  Synthetic
guggagaccuccaucagc

SEQ ID NO: 8244 - RNA, 19 nt, Artificial Sequence
  Synthetic
cguggagaccuccaucagc

SEQ ID NO: 8245 - RNA, 20 nt, Artificial Sequence
  Synthetic
gcguggagaccuccaucagc

SEQ ID NO: 8246 - RNA, 21 nt, Artificial Sequence
  Synthetic
ggcguggagaccuccaucagc

SEQ ID NO: 8247 - RNA, 22 nt, Artificial Sequence
  Synthetic
uggcguggagaccuccaucagc

SEQ ID NO: 8248 - RNA, 23 nt, Artificial Sequence
  Synthetic
cuggcguggagaccuccaucagc

SEQ ID NO: 8249 - RNA, 24 nt, Artificial Sequence
  Synthetic
ccuggcguggagaccuccaucagc

SEQ ID NO: 8250 - RNA, 18 nt, Artificial Sequence
  Synthetic
cggaaauuaaagaggagc

SEQ ID NO: 8251 - RNA, 19 nt, Artificial Sequence
  Synthetic
ccggaaauuaaagaggagc

SEQ ID NO: 8252 - RNA, 21 nt, Artificial Sequence
  Synthetic
acccggaaauuaaagaggagc

SEQ ID NO: 8253 - RNA, 22 nt, Artificial Sequence
  Synthetic
uacccggaaauuaaagaggagc

SEQ ID NO: 8254 - RNA, 23 nt, Artificial Sequence
  Synthetic
guacccggaaauuaaagaggagc

SEQ ID NO: 8255 - RNA, 24 nt, Artificial Sequence
  Synthetic
gguacccggaaauuaaagaggagc

SEQ ID NO: 8256 - RNA, 18 nt, Artificial Sequence
  Synthetic
ccgcaccccuugcagcgc

SEQ ID NO: 8257 - RNA, 19 nt, Artificial Sequence
  Synthetic
gccgcaccccuugcagcgc

SEQ ID NO: 8258 - RNA, 20 nt, Artificial Sequence
  Synthetic
ugccgcaccccuugcagcgc

SEQ ID NO: 8259 - RNA, 21 nt, Artificial Sequence
  Synthetic
cugccgcaccccuugcagcgc

SEQ ID NO: 8260 - RNA, 22 nt, Artificial Sequence
  Synthetic
ucugccgcaccccuugcagcgc

SEQ ID NO: 8261 - RNA, 23 nt, Artificial Sequence
  Synthetic
cucugccgcaccccuugcagcgc

SEQ ID NO: 8262 - RNA, 24 nt, Artificial Sequence
  Synthetic
acucugccgcaccccuugcagcgc

SEQ ID NO: 8263 - RNA, 18 nt, Artificial Sequence
  Synthetic
ggaugcugacugggaggc

SEQ ID NO: 8264 - RNA, 19 nt, Artificial Sequence
  Synthetic
aggaugcugacugggaggc

SEQ ID NO: 8265 - RNA, 20 nt, Artificial Sequence
  Synthetic
aaggaugcugacugggaggc

SEQ ID NO: 8266 - RNA, 21 nt, Artificial Sequence
  Synthetic
caaggaugcugacugggaggc

SEQ ID NO: 8267 - RNA, 22 nt, Artificial Sequence
  Synthetic
gcaaggaugcugacugggaggc

SEQ ID NO: 8268 - RNA, 23 nt, Artificial Sequence
  Synthetic
ggcaaggaugcugacugggaggc

SEQ ID NO: 8269 - RNA, 24 nt, Artificial Sequence
  Synthetic
aggcaaggaugcugacugggaggc

SEQ ID NO: 8270 - RNA, 18 nt, Artificial Sequence
  Synthetic
uuuaacuugcggccuggc

SEQ ID NO: 8271 - RNA, 19 nt, Artificial Sequence
  Synthetic
cuuuaacuugcggccuggc

SEQ ID NO: 8272 - RNA, 20 nt, Artificial Sequence
  Synthetic
gcuuuaacuugcggccuggc

SEQ ID NO: 8273 - RNA, 21 nt, Artificial Sequence
  Synthetic
ggcuuuaacuugcggccuggc

SEQ ID NO: 8274 - RNA, 22 nt, Artificial Sequence
  Synthetic
uggcuuuaacuugcggccuggc

SEQ ID NO: 8275 - RNA, 23 nt, Artificial Sequence
  Synthetic
guggcuuuaacuugcggccuggc

SEQ ID NO: 8276 - RNA, 24 nt, Artificial Sequence
  Synthetic
gguggcuuuaacuugcggccuggc

SEQ ID NO: 8277 - RNA, 18 nt, Artificial Sequence
  Synthetic
ucuggaugucuuccaugc

SEQ ID NO: 8278 - RNA, 19 nt, Artificial Sequence
  Synthetic
cucuggaugucuuccaugc

SEQ ID NO: 8279 - RNA, 20 nt, Artificial Sequence
  Synthetic
ccucuggaugucuuccaugc

SEQ ID NO: 8280 - RNA, 21 nt, Artificial Sequence
  Synthetic
accucuggaugucuuccaugc

SEQ ID NO: 8281 - RNA, 22 nt, Artificial Sequence
  Synthetic
aaccucuggaugucuuccaugc

SEQ ID NO: 8282 - RNA, 23 nt, Artificial Sequence
  Synthetic
caaccucuggaugucuuccaugc

SEQ ID NO: 8283 - RNA, 24 nt, Artificial Sequence
  Synthetic
ccaaccucuggaugucuuccaugc

SEQ ID NO: 8284 - RNA, 18 nt, Artificial Sequence
  Synthetic
gcagccgucgcgaccugc

SEQ ID NO: 8285 - RNA, 19 nt, Artificial Sequence
  Synthetic
cgcagccgucgcgaccugc

SEQ ID NO: 8286 - RNA, 21 nt, Artificial Sequence
  Synthetic
cccgcagccgucgcgaccugc

SEQ ID NO: 8287 - RNA, 22 nt, Artificial Sequence
  Synthetic
ucccgcagccgucgcgaccugc

SEQ ID NO: 8288 - RNA, 23 nt, Artificial Sequence
  Synthetic
cucccgcagccgucgcgaccugc

SEQ ID NO: 8289 - RNA, 24 nt, Artificial Sequence
  Synthetic
gcucccgcagccgucgcgaccugc

SEQ ID NO: 8290 - RNA, 18 nt, Artificial Sequence
  Synthetic
acauccugucgaggcugc

SEQ ID NO: 8291 - RNA, 19 nt, Artificial Sequence
  Synthetic
aacauccugucgaggcugc

SEQ ID NO: 8292 - RNA, 20 nt, Artificial Sequence
  Synthetic
caacauccugucgaggcugc

SEQ ID NO: 8293 - RNA, 21 nt, Artificial Sequence
  Synthetic
ucaacauccugucgaggcugc

SEQ ID NO: 8294 - RNA, 22 nt, Artificial Sequence
  Synthetic
aucaacauccugucgaggcugc

SEQ ID NO: 8295 - RNA, 23 nt, Artificial Sequence
  Synthetic
caucaacauccugucgaggcugc

SEQ ID NO: 8296 - RNA, 24 nt, Artificial Sequence
  Synthetic
acaucaacauccugucgaggcugc

SEQ ID NO: 8297 - RNA, 18 nt, Artificial Sequence
  Synthetic
aucuccagggggcucugc

SEQ ID NO: 8298 - RNA, 19 nt, Artificial Sequence
  Synthetic
caucuccagggggcucugc

SEQ ID NO: 8299 - RNA, 21 nt, Artificial Sequence
  Synthetic
cccaucuccagggggcucugc

SEQ ID NO: 8300 - RNA, 22 nt, Artificial Sequence
  Synthetic
gcccaucuccagggggcucugc

SEQ ID NO: 8301 - RNA, 23 nt, Artificial Sequence
  Synthetic
cgcccaucuccagggggcucugc

SEQ ID NO: 8302 - RNA, 24 nt, Artificial Sequence
  Synthetic
ccgcccaucuccagggggcucugc

SEQ ID NO: 8303 - RNA, 18 nt, Artificial Sequence
  Synthetic
ggcuguuucaccaagugc

SEQ ID NO: 8304 - RNA, 19 nt, Artificial Sequence
  Synthetic
gggcuguuucaccaagugc

SEQ ID NO: 8305 - RNA, 21 nt, Artificial Sequence
  Synthetic
cugggcuguuucaccaagugc

SEQ ID NO: 8306 - RNA, 22 nt, Artificial Sequence
  Synthetic
ccugggcuguuucaccaagugc

SEQ ID NO: 8307 - RNA, 23 nt, Artificial Sequence
  Synthetic
accugggcuguuucaccaagugc

SEQ ID NO: 8308 - RNA, 24 nt, Artificial Sequence
  Synthetic
caccugggcuguuucaccaagugc

SEQ ID NO: 8309 - RNA, 18 nt, Artificial Sequence
  Synthetic
gggcccggguaauggugc

SEQ ID NO: 8310 - RNA, 19 nt, Artificial Sequence
  Synthetic
ggggcccggguaauggugc

SEQ ID NO: 8311 - RNA, 20 nt, Artificial Sequence
  Synthetic
uggggcccggguaauggugc

SEQ ID NO: 8312 - RNA, 21 nt, Artificial Sequence
  Synthetic
cuggggcccggguaauggugc

SEQ ID NO: 8313 - RNA, 22 nt, Artificial Sequence
  Synthetic
acuggggcccggguaauggugc

SEQ ID NO: 8314 - RNA, 23 nt, Artificial Sequence
  Synthetic
gacuggggcccggguaauggugc

SEQ ID NO: 8315 - RNA, 24 nt, Artificial Sequence
  Synthetic
ugacuggggcccggguaauggugc

SEQ ID NO: 8316 - RNA, 18 nt, Artificial Sequence
  Synthetic
uuccaggagagcaugauc

SEQ ID NO: 8317 - RNA, 19 nt, Artificial Sequence
  Synthetic
cuuccaggagagcaugauc

SEQ ID NO: 8318 - RNA, 20 nt, Artificial Sequence
  Synthetic
gcuuccaggagagcaugauc

SEQ ID NO: 8319 - RNA, 21 nt, Artificial Sequence
  Synthetic
ugcuuccaggagagcaugauc

SEQ ID NO: 8320 - RNA, 22 nt, Artificial Sequence
  Synthetic
cugcuuccaggagagcaugauc

SEQ ID NO: 8321 - RNA, 23 nt, Artificial Sequence
  Synthetic
ccugcuuccaggagagcaugauc

SEQ ID NO: 8322 - RNA, 24 nt, Artificial Sequence
  Synthetic
uccugcuuccaggagagcaugauc

SEQ ID NO: 8323 - RNA, 18 nt, Artificial Sequence
  Synthetic
guuccuggggugagacuc

SEQ ID NO: 8324 - RNA, 19 nt, Artificial Sequence
  Synthetic
aguuccuggggugagacuc

SEQ ID NO: 8325 - RNA, 20 nt, Artificial Sequence
  Synthetic
caguuccuggggugagacuc

SEQ ID NO: 8326 - RNA, 21 nt, Artificial Sequence
  Synthetic
acaguuccuggggugagacuc

SEQ ID NO: 8327 - RNA, 22 nt, Artificial Sequence
  Synthetic
cacaguuccuggggugagacuc

SEQ ID NO: 8328 - RNA, 23 nt, Artificial Sequence
  Synthetic
gcacaguuccuggggugagacuc

SEQ ID NO: 8329 - RNA, 24 nt, Artificial Sequence
  Synthetic
agcacaguuccuggggugagacuc

SEQ ID NO: 8330 - RNA, 18 nt, Artificial Sequence
  Synthetic
gggucccgcccccgccuc

SEQ ID NO: 8331 - RNA, 19 nt, Artificial Sequence
  Synthetic
agggucccgcccccgccuc

SEQ ID NO: 8332 - RNA, 20 nt, Artificial Sequence
  Synthetic
gagggucccgcccccgccuc

SEQ ID NO: 8333 - RNA, 21 nt, Artificial Sequence
  Synthetic
ugagggucccgcccccgccuc

SEQ ID NO: 8334 - RNA, 22 nt, Artificial Sequence
  Synthetic
cugagggucccgcccccgccuc

SEQ ID NO: 8335 - RNA, 23 nt, Artificial Sequence
  Synthetic
ccugagggucccgcccccgccuc

SEQ ID NO: 8336 - RNA, 24 nt, Artificial Sequence
  Synthetic
gccugagggucccgcccccgccuc

SEQ ID NO: 8337 - RNA, 18 nt, Artificial Sequence
  Synthetic
guuccuccaccuguccuc

SEQ ID NO: 8338 - RNA, 19 nt, Artificial Sequence
  Synthetic
aguuccuccaccuguccuc

SEQ ID NO: 8339 - RNA, 21 nt, Artificial Sequence
  Synthetic
ccaguuccuccaccuguccuc

SEQ ID NO: 8340 - RNA, 22 nt, Artificial Sequence
  Synthetic
gccaguuccuccaccuguccuc

SEQ ID NO: 8341 - RNA, 23 nt, Artificial Sequence
  Synthetic
ggccaguuccuccaccuguccuc

SEQ ID NO: 8342 - RNA, 24 nt, Artificial Sequence
  Synthetic
gggccaguuccuccaccuguccuc

SEQ ID NO: 8343 - RNA, 18 nt, Artificial Sequence
  Synthetic
gagggggcaggggugcuc

SEQ ID NO: 8344 - RNA, 19 nt, Artificial Sequence
  Synthetic
cgagggggcaggggugcuc

SEQ ID NO: 8345 - RNA, 21 nt, Artificial Sequence
  Synthetic
gccgagggggcaggggugcuc

SEQ ID NO: 8346 - RNA, 22 nt, Artificial Sequence
  Synthetic
ggccgagggggcaggggugcuc

SEQ ID NO: 8347 - RNA, 23 nt, Artificial Sequence
  Synthetic
aggccgagggggcaggggugcuc

SEQ ID NO: 8348 - RNA, 24 nt, Artificial Sequence
  Synthetic
caggccgagggggcaggggugcuc

SEQ ID NO: 8349 - RNA, 18 nt, Artificial Sequence
  Synthetic
ugggcccccgcccaucuc

SEQ ID NO: 8350 - RNA, 19 nt, Artificial Sequence
  Synthetic
cugggcccccgcccaucuc

SEQ ID NO: 8351 - RNA, 20 nt, Artificial Sequence
  Synthetic
ccugggcccccgcccaucuc

SEQ ID NO: 8352 - RNA, 21 nt, Artificial Sequence
  Synthetic
cccugggcccccgcccaucuc

SEQ ID NO: 8353 - RNA, 22 nt, Artificial Sequence
  Synthetic
acccugggcccccgcccaucuc

SEQ ID NO: 8354 - RNA, 23 nt, Artificial Sequence
  Synthetic
cacccugggcccccgcccaucuc

SEQ ID NO: 8355 - RNA, 24 nt, Artificial Sequence
  Synthetic
ccacccugggcccccgcccaucuc

SEQ ID NO: 8356 - RNA, 18 nt, Artificial Sequence
  Synthetic
uguauucacuccugcuuc

SEQ ID NO: 8357 - RNA, 19 nt, Artificial Sequence
  Synthetic
guguauucacuccugcuuc

SEQ ID NO: 8358 - RNA, 20 nt, Artificial Sequence
  Synthetic
uguguauucacuccugcuuc

SEQ ID NO: 8359 - RNA, 21 nt, Artificial Sequence
  Synthetic
guguguauucacuccugcuuc

SEQ ID NO: 8360 - RNA, 22 nt, Artificial Sequence
  Synthetic
gguguguauucacuccugcuuc

SEQ ID NO: 8361 - RNA, 23 nt, Artificial Sequence
  Synthetic
agguguguauucacuccugcuuc

SEQ ID NO: 8362 - RNA, 24 nt, Artificial Sequence
  Synthetic
cagguguguauucacuccugcuuc

SEQ ID NO: 8363 - RNA, 18 nt, Artificial Sequence
  Synthetic
aaagucaacaucuucuuc

SEQ ID NO: 8364 - RNA, 19 nt, Artificial Sequence
  Synthetic
caaagucaacaucuucuuc

SEQ ID NO: 8365 - RNA, 20 nt, Artificial Sequence
  Synthetic
ccaaagucaacaucuucuuc

SEQ ID NO: 8366 - RNA, 21 nt, Artificial Sequence
  Synthetic
gccaaagucaacaucuucuuc

SEQ ID NO: 8367 - RNA, 22 nt, Artificial Sequence
  Synthetic
ggccaaagucaacaucuucuuc

SEQ ID NO: 8368 - RNA, 23 nt, Artificial Sequence
  Synthetic
uggccaaagucaacaucuucuuc

SEQ ID NO: 8369 - RNA, 24 nt, Artificial Sequence
  Synthetic
guggccaaagucaacaucuucuuc

SEQ ID NO: 8370 - RNA, 18 nt, Artificial Sequence
  Synthetic
cuacagaaagcacaguuc

SEQ ID NO: 8371 - RNA, 19 nt, Artificial Sequence
  Synthetic
acuacagaaagcacaguuc

SEQ ID NO: 8372 - RNA, 20 nt, Artificial Sequence
  Synthetic
gacuacagaaagcacaguuc

SEQ ID NO: 8373 - RNA, 21 nt, Artificial Sequence
  Synthetic
ugacuacagaaagcacaguuc

SEQ ID NO: 8374 - RNA, 22 nt, Artificial Sequence
  Synthetic
gugacuacagaaagcacaguuc

SEQ ID NO: 8375 - RNA, 23 nt, Artificial Sequence
  Synthetic
ugugacuacagaaagcacaguuc

SEQ ID NO: 8376 - RNA, 24 nt, Artificial Sequence
  Synthetic
cugugacuacagaaagcacaguuc

SEQ ID NO: 8377 - RNA, 18 nt, Artificial Sequence
  Synthetic
gguacccggaaauuaaag

SEQ ID NO: 8378 - RNA, 19 nt, Artificial Sequence
  Synthetic
agguacccggaaauuaaag

SEQ ID NO: 8379 - RNA, 21 nt, Artificial Sequence
  Synthetic
ucagguacccggaaauuaaag

SEQ ID NO: 8380 - RNA, 22 nt, Artificial Sequence
  Synthetic
uucagguacccggaaauuaaag

SEQ ID NO: 8381 - RNA, 23 nt, Artificial Sequence
  Synthetic
cuucagguacccggaaauuaaag

SEQ ID NO: 8382 - RNA, 24 nt, Artificial Sequence
  Synthetic
ccuucagguacccggaaauuaaag

SEQ ID NO: 8383 - RNA, 18 nt, Artificial Sequence
  Synthetic
ggggcccugagagggaag

SEQ ID NO: 8384 - RNA, 19 nt, Artificial Sequence
  Synthetic
gggggcccugagagggaag

SEQ ID NO: 8385 - RNA, 20 nt, Artificial Sequence
  Synthetic
ggggggcccugagagggaag

SEQ ID NO: 8386 - RNA, 21 nt, Artificial Sequence
  Synthetic
gggggggcccugagagggaag

SEQ ID NO: 8387 - RNA, 22 nt, Artificial Sequence
  Synthetic
ugggggggcccugagagggaag

SEQ ID NO: 8388 - RNA, 23 nt, Artificial Sequence
  Synthetic
cugggggggcccugagagggaag

SEQ ID NO: 8389 - RNA, 24 nt, Artificial Sequence
  Synthetic
ucugggggggcccugagagggaag

SEQ ID NO: 8390 - RNA, 18 nt, Artificial Sequence
  Synthetic
cgggacaacaacccccag

SEQ ID NO: 8391 - RNA, 19 nt, Artificial Sequence
  Synthetic
gcgggacaacaacccccag

SEQ ID NO: 8392 - RNA, 20 nt, Artificial Sequence
  Synthetic
ugcgggacaacaacccccag

SEQ ID NO: 8393 - RNA, 21 nt, Artificial Sequence
  Synthetic
uugcgggacaacaacccccag

SEQ ID NO: 8394 - RNA, 22 nt, Artificial Sequence
  Synthetic
cuugcgggacaacaacccccag

SEQ ID NO: 8395 - RNA, 23 nt, Artificial Sequence
  Synthetic
gcuugcgggacaacaacccccag

SEQ ID NO: 8396 - RNA, 24 nt, Artificial Sequence
  Synthetic
agcuugcgggacaacaacccccag

SEQ ID NO: 8397 - RNA, 18 nt, Artificial Sequence
  Synthetic
uccaaccugggcagccag

SEQ ID NO: 8398 - RNA, 19 nt, Artificial Sequence
  Synthetic
guccaaccugggcagccag

SEQ ID NO: 8399 - RNA, 21 nt, Artificial Sequence
  Synthetic
cuguccaaccugggcagccag

SEQ ID NO: 8400 - RNA, 22 nt, Artificial Sequence
  Synthetic
ccuguccaaccugggcagccag

SEQ ID NO: 8401 - RNA, 23 nt, Artificial Sequence
  Synthetic
uccuguccaaccugggcagccag

SEQ ID NO: 8402 - RNA, 24 nt, Artificial Sequence
  Synthetic
cuccuguccaaccugggcagccag

SEQ ID NO: 8403 - RNA, 18 nt, Artificial Sequence
  Synthetic
auucacuccugcuuccag

SEQ ID NO: 8404 - RNA, 19 nt, Artificial Sequence
  Synthetic
uauucacuccugcuuccag

SEQ ID NO: 8405 - RNA, 20 nt, Artificial Sequence
  Synthetic
guauucacuccugcuuccag

SEQ ID NO: 8406 - RNA, 21 nt, Artificial Sequence
  Synthetic
uguauucacuccugcuuccag

SEQ ID NO: 8407 - RNA, 22 nt, Artificial Sequence
  Synthetic
guguauucacuccugcuuccag

SEQ ID NO: 8408 - RNA, 23 nt, Artificial Sequence
  Synthetic
uguguauucacuccugcuuccag

SEQ ID NO: 8409 - RNA, 24 nt, Artificial Sequence
  Synthetic
guguguauucacuccugcuuccag

SEQ ID NO: 8410 - RNA, 18 nt, Artificial Sequence
  Synthetic
ucaaaguacacacagcag

SEQ ID NO: 8411 - RNA, 19 nt, Artificial Sequence
  Synthetic
uucaaaguacacacagcag

SEQ ID NO: 8412 - RNA, 20 nt, Artificial Sequence
  Synthetic
cuucaaaguacacacagcag

SEQ ID NO: 8413 - RNA, 21 nt, Artificial Sequence
  Synthetic
ccuucaaaguacacacagcag

SEQ ID NO: 8414 - RNA, 22 nt, Artificial Sequence
  Synthetic
cccuucaaaguacacacagcag

SEQ ID NO: 8415 - RNA, 23 nt, Artificial Sequence
  Synthetic
acccuucaaaguacacacagcag

SEQ ID NO: 8416 - RNA, 24 nt, Artificial Sequence
  Synthetic
uacccuucaaaguacacacagcag

SEQ ID NO: 8417 - RNA, 18 nt, Artificial Sequence
  Synthetic
aacaucuucuucaaggag

SEQ ID NO: 8418 - RNA, 19 nt, Artificial Sequence
  Synthetic
caacaucuucuucaaggag

SEQ ID NO: 8419 - RNA, 20 nt, Artificial Sequence
  Synthetic
ucaacaucuucuucaaggag

SEQ ID NO: 8420 - RNA, 21 nt, Artificial Sequence
  Synthetic
gucaacaucuucuucaaggag

SEQ ID NO: 8421 - RNA, 22 nt, Artificial Sequence
  Synthetic
agucaacaucuucuucaaggag

SEQ ID NO: 8422 - RNA, 23 nt, Artificial Sequence
  Synthetic
aagucaacaucuucuucaaggag

SEQ ID NO: 8423 - RNA, 24 nt, Artificial Sequence
  Synthetic
aaagucaacaucuucuucaaggag

SEQ ID NO: 8424 - RNA, 18 nt, Artificial Sequence
  Synthetic
ccggaaauuaaagaggag

SEQ ID NO: 8425 - RNA, 19 nt, Artificial Sequence
  Synthetic
cccggaaauuaaagaggag

SEQ ID NO: 8426 - RNA, 20 nt, Artificial Sequence
  Synthetic
acccggaaauuaaagaggag

SEQ ID NO: 8427 - RNA, 21 nt, Artificial Sequence
  Synthetic
uacccggaaauuaaagaggag

SEQ ID NO: 8428 - RNA, 22 nt, Artificial Sequence
  Synthetic
guacccggaaauuaaagaggag

SEQ ID NO: 8429 - RNA, 23 nt, Artificial Sequence
  Synthetic
gguacccggaaauuaaagaggag

SEQ ID NO: 8430 - RNA, 24 nt, Artificial Sequence
  Synthetic
agguacccggaaauuaaagaggag

SEQ ID NO: 8431 - RNA, 18 nt, Artificial Sequence
  Synthetic
aaagaggagcuggaggag

SEQ ID NO: 8432 - RNA, 19 nt, Artificial Sequence
  Synthetic
uaaagaggagcuggaggag

SEQ ID NO: 8433 - RNA, 20 nt, Artificial Sequence
  Synthetic
uuaaagaggagcuggaggag

SEQ ID NO: 8434 - RNA, 21 nt, Artificial Sequence
  Synthetic
auuaaagaggagcuggaggag

SEQ ID NO: 8435 - RNA, 22 nt, Artificial Sequence
  Synthetic
aauuaaagaggagcuggaggag

SEQ ID NO: 8436 - RNA, 23 nt, Artificial Sequence
  Synthetic
aaauuaaagaggagcuggaggag

SEQ ID NO: 8437 - RNA, 24 nt, Artificial Sequence
  Synthetic
gaaauuaaagaggagcuggaggag

SEQ ID NO: 8438 - RNA, 18 nt, Artificial Sequence
  Synthetic
acucugccaucccuggag

SEQ ID NO: 8439 - RNA, 19 nt, Artificial Sequence
  Synthetic
gacucugccaucccuggag

SEQ ID NO: 8440 - RNA, 20 nt, Artificial Sequence
  Synthetic
agacucugccaucccuggag

SEQ ID NO: 8441 - RNA, 21 nt, Artificial Sequence
  Synthetic
gagacucugccaucccuggag

SEQ ID NO: 8442 - RNA, 22 nt, Artificial Sequence
  Synthetic
agagacucugccaucccuggag

SEQ ID NO: 8443 - RNA, 23 nt, Artificial Sequence
  Synthetic
cagagacucugccaucccuggag

SEQ ID NO: 8444 - RNA, 24 nt, Artificial Sequence
  Synthetic
ccagagacucugccaucccuggag

SEQ ID NO: 8445 - RNA, 18 nt, Artificial Sequence
  Synthetic
cucugggggggcccugag

SEQ ID NO: 8446 - RNA, 19 nt, Artificial Sequence
  Synthetic
ccucugggggggcccugag

SEQ ID NO: 8447 - RNA, 21 nt, Artificial Sequence
  Synthetic
guccucugggggggcccugag

SEQ ID NO: 8448 - RNA, 22 nt, Artificial Sequence
  Synthetic
uguccucugggggggcccugag

SEQ ID NO: 8449 - RNA, 23 nt, Artificial Sequence
  Synthetic
cuguccucugggggggcccugag

SEQ ID NO: 8450 - RNA, 24 nt, Artificial Sequence
  Synthetic
ccuguccucugggggggcccugag

SEQ ID NO: 8451 - RNA, 18 nt, Artificial Sequence
  Synthetic
ugccuggaaucaacaacg

SEQ ID NO: 8452 - RNA, 19 nt, Artificial Sequence
  Synthetic
augccuggaaucaacaacg

SEQ ID NO: 8453 - RNA, 20 nt, Artificial Sequence
  Synthetic
caugccuggaaucaacaacg

SEQ ID NO: 8454 - RNA, 21 nt, Artificial Sequence
  Synthetic
ccaugccuggaaucaacaacg

SEQ ID NO: 8455 - RNA, 22 nt, Artificial Sequence
  Synthetic
uccaugccuggaaucaacaacg

SEQ ID NO: 8456 - RNA, 23 nt, Artificial Sequence
  Synthetic
uuccaugccuggaaucaacaacg

SEQ ID NO: 8457 - RNA, 24 nt, Artificial Sequence
  Synthetic
cuuccaugccuggaaucaacaacg

SEQ ID NO: 8458 - RNA, 18 nt, Artificial Sequence
  Synthetic
ucccuggaggaggacacg

SEQ ID NO: 8459 - RNA, 19 nt, Artificial Sequence
  Synthetic
aucccuggaggaggacacg

SEQ ID NO: 8460 - RNA, 20 nt, Artificial Sequence
  Synthetic
caucccuggaggaggacacg

SEQ ID NO: 8461 - RNA, 21 nt, Artificial Sequence
  Synthetic
ccaucccuggaggaggacacg

SEQ ID NO: 8462 - RNA, 22 nt, Artificial Sequence
  Synthetic
gccaucccuggaggaggacacg

SEQ ID NO: 8463 - RNA, 23 nt, Artificial Sequence
  Synthetic
ugccaucccuggaggaggacacg

SEQ ID NO: 8464 - RNA, 24 nt, Artificial Sequence
  Synthetic
cugccaucccuggaggaggacacg

SEQ ID NO: 8465 - RNA, 18 nt, Artificial Sequence
  Synthetic
cccgccucacggggcccg

SEQ ID NO: 8466 - RNA, 19 nt, Artificial Sequence
  Synthetic
ccccgccucacggggcccg

SEQ ID NO: 8467 - RNA, 20 nt, Artificial Sequence
  Synthetic
cccccgccucacggggcccg

SEQ ID NO: 8468 - RNA, 21 nt, Artificial Sequence
  Synthetic
gcccccgccucacggggcccg

SEQ ID NO: 8469 - RNA, 22 nt, Artificial Sequence
  Synthetic
cgcccccgccucacggggcccg

SEQ ID NO: 8470 - RNA, 23 nt, Artificial Sequence
  Synthetic
ccgcccccgccucacggggcccg

SEQ ID NO: 8471 - RNA, 24 nt, Artificial Sequence
  Synthetic
cccgcccccgccucacggggcccg

SEQ ID NO: 8472 - RNA, 18 nt, Artificial Sequence
  Synthetic
gugaggcccgcagcgccg

SEQ ID NO: 8473 - RNA, 19 nt, Artificial Sequence
  Synthetic
ggugaggcccgcagcgccg

SEQ ID NO: 8474 - RNA, 21 nt, Artificial Sequence
  Synthetic
cuggugaggcccgcagcgccg

SEQ ID NO: 8475 - RNA, 22 nt, Artificial Sequence
  Synthetic
gcuggugaggcccgcagcgccg

SEQ ID NO: 8476 - RNA, 23 nt, Artificial Sequence
  Synthetic
agcuggugaggcccgcagcgccg

SEQ ID NO: 8477 - RNA, 24 nt, Artificial Sequence
  Synthetic
cagcuggugaggcccgcagcgccg

SEQ ID NO: 8478 - RNA, 18 nt, Artificial Sequence
  Synthetic
auacuggucuccaggccg

SEQ ID NO: 8479 - RNA, 19 nt, Artificial Sequence
  Synthetic
gauacuggucuccaggccg

SEQ ID NO: 8480 - RNA, 21 nt, Artificial Sequence
  Synthetic
ccgauacuggucuccaggccg

SEQ ID NO: 8481 - RNA, 22 nt, Artificial Sequence
  Synthetic
gccgauacuggucuccaggccg

SEQ ID NO: 8482 - RNA, 23 nt, Artificial Sequence
  Synthetic
agccgauacuggucuccaggccg

SEQ ID NO: 8483 - RNA, 24 nt, Artificial Sequence
  Synthetic
aagccgauacuggucuccaggccg

SEQ ID NO: 8484 - RNA, 18 nt, Artificial Sequence
  Synthetic
cuggugaggcccgcagcg

SEQ ID NO: 8485 - RNA, 19 nt, Artificial Sequence
  Synthetic
gcuggugaggcccgcagcg

SEQ ID NO: 8486 - RNA, 20 nt, Artificial Sequence
  Synthetic
agcuggugaggcccgcagcg

SEQ ID NO: 8487 - RNA, 21 nt, Artificial Sequence
  Synthetic
cagcuggugaggcccgcagcg

SEQ ID NO: 8488 - RNA, 22 nt, Artificial Sequence
  Synthetic
ccagcuggugaggcccgcagcg

SEQ ID NO: 8489 - RNA, 23 nt, Artificial Sequence
  Synthetic
uccagcuggugaggcccgcagcg

SEQ ID NO: 8490 - RNA, 24 nt, Artificial Sequence
  Synthetic
uuccagcuggugaggcccgcagcg

SEQ ID NO: 8491 - RNA, 18 nt, Artificial Sequence
  Synthetic
ugucccugaugcugcgcg

SEQ ID NO: 8492 - RNA, 19 nt, Artificial Sequence
  Synthetic
cugucccugaugcugcgcg

SEQ ID NO: 8493 - RNA, 20 nt, Artificial Sequence
  Synthetic
ucugucccugaugcugcgcg

SEQ ID NO: 8494 - RNA, 21 nt, Artificial Sequence
  Synthetic
gucugucccugaugcugcgcg

SEQ ID NO: 8495 - RNA, 22 nt, Artificial Sequence
  Synthetic
ggucugucccugaugcugcgcg

SEQ ID NO: 8496 - RNA, 23 nt, Artificial Sequence
  Synthetic
aggucugucccugaugcugcgcg

SEQ ID NO: 8497 - RNA, 24 nt, Artificial Sequence
  Synthetic
uaggucugucccugaugcugcgcg

SEQ ID NO: 8498 - RNA, 18 nt, Artificial Sequence
  Synthetic
uuaacuugcggccuggcg

SEQ ID NO: 8499 - RNA, 19 nt, Artificial Sequence
  Synthetic
uuuaacuugcggccuggcg

SEQ ID NO: 8500 - RNA, 21 nt, Artificial Sequence
  Synthetic
gcuuuaacuugcggccuggcg

SEQ ID NO: 8501 - RNA, 22 nt, Artificial Sequence
  Synthetic
ggcuuuaacuugcggccuggcg

SEQ ID NO: 8502 - RNA, 23 nt, Artificial Sequence
  Synthetic
uggcuuuaacuugcggccuggcg

SEQ ID NO: 8503 - RNA, 24 nt, Artificial Sequence
  Synthetic
guggcuuuaacuugcggccuggcg

SEQ ID NO: 8504 - RNA, 18 nt, Artificial Sequence
  Synthetic
ucaucagggguggaugcg

SEQ ID NO: 8505 - RNA, 19 nt, Artificial Sequence
  Synthetic
cucaucagggguggaugcg

SEQ ID NO: 8506 - RNA, 20 nt, Artificial Sequence
  Synthetic
acucaucagggguggaugcg

SEQ ID NO: 8507 - RNA, 21 nt, Artificial Sequence
  Synthetic
uacucaucagggguggaugcg

SEQ ID NO: 8508 - RNA, 22 nt, Artificial Sequence
  Synthetic
auacucaucagggguggaugcg

SEQ ID NO: 8509 - RNA, 23 nt, Artificial Sequence
  Synthetic
cauacucaucagggguggaugcg

SEQ ID NO: 8510 - RNA, 24 nt, Artificial Sequence
  Synthetic
acauacucaucagggguggaugcg

SEQ ID NO: 8511 - RNA, 18 nt, Artificial Sequence
  Synthetic
cagccgucgcgaccugcg

SEQ ID NO: 8512 - RNA, 19 nt, Artificial Sequence
  Synthetic
gcagccgucgcgaccugcg

SEQ ID NO: 8513 - RNA, 21 nt, Artificial Sequence
  Synthetic
ccgcagccgucgcgaccugcg

SEQ ID NO: 8514 - RNA, 22 nt, Artificial Sequence
  Synthetic
cccgcagccgucgcgaccugcg

SEQ ID NO: 8515 - RNA, 23 nt, Artificial Sequence
  Synthetic
ucccgcagccgucgcgaccugcg

SEQ ID NO: 8516 - RNA, 24 nt, Artificial Sequence
  Synthetic
cucccgcagccgucgcgaccugcg

SEQ ID NO: 8517 - RNA, 18 nt, Artificial Sequence
  Synthetic
ccgauacuggucuccagg

SEQ ID NO: 8518 - RNA, 19 nt, Artificial Sequence
  Synthetic
gccgauacuggucuccagg

SEQ ID NO: 8519 - RNA, 20 nt, Artificial Sequence
  Synthetic
agccgauacuggucuccagg

SEQ ID NO: 8520 - RNA, 21 nt, Artificial Sequence
  Synthetic
aagccgauacuggucuccagg

SEQ ID NO: 8521 - RNA, 22 nt, Artificial Sequence
  Synthetic
gaagccgauacuggucuccagg

SEQ ID NO: 8522 - RNA, 23 nt, Artificial Sequence
  Synthetic
cgaagccgauacuggucuccagg

SEQ ID NO: 8523 - RNA, 24 nt, Artificial Sequence
  Synthetic
ccgaagccgauacuggucuccagg

SEQ ID NO: 8524 - RNA, 18 nt, Artificial Sequence
  Synthetic
uaauggugcacgggcagg

SEQ ID NO: 8525 - RNA, 19 nt, Artificial Sequence
  Synthetic
guaauggugcacgggcagg

SEQ ID NO: 8526 - RNA, 20 nt, Artificial Sequence
  Synthetic
gguaauggugcacgggcagg

SEQ ID NO: 8527 - RNA, 21 nt, Artificial Sequence
  Synthetic
ggguaauggugcacgggcagg

SEQ ID NO: 8528 - RNA, 22 nt, Artificial Sequence
  Synthetic
cggguaauggugcacgggcagg

SEQ ID NO: 8529 - RNA, 23 nt, Artificial Sequence
  Synthetic
ccggguaauggugcacgggcagg

SEQ ID NO: 8530 - RNA, 24 nt, Artificial Sequence
  Synthetic
cccggguaauggugcacgggcagg

SEQ ID NO: 8531 - RNA, 18 nt, Artificial Sequence
  Synthetic
gggggggcccugagaggg

SEQ ID NO: 8532 - RNA, 19 nt, Artificial Sequence
  Synthetic
ugggggggcccugagaggg

SEQ ID NO: 8533 - RNA, 20 nt, Artificial Sequence
  Synthetic
cugggggggcccugagaggg

SEQ ID NO: 8534 - RNA, 21 nt, Artificial Sequence
  Synthetic
ucugggggggcccugagaggg

SEQ ID NO: 8535 - RNA, 22 nt, Artificial Sequence
  Synthetic
cucugggggggcccugagaggg

SEQ ID NO: 8536 - RNA, 23 nt, Artificial Sequence
  Synthetic
ccucugggggggcccugagaggg

SEQ ID NO: 8537 - RNA, 24 nt, Artificial Sequence
  Synthetic
uccucugggggggcccugagaggg

SEQ ID NO: 8538 - RNA, 18 nt, Artificial Sequence
  Synthetic
gucuccaggccgaggggg

SEQ ID NO: 8539 - RNA, 19 nt, Artificial Sequence
  Synthetic
ggucuccaggccgaggggg

SEQ ID NO: 8540 - RNA, 20 nt, Artificial Sequence
  Synthetic
uggucuccaggccgaggggg

SEQ ID NO: 8541 - RNA, 21 nt, Artificial Sequence
  Synthetic
cuggucuccaggccgaggggg

SEQ ID NO: 8542 - RNA, 22 nt, Artificial Sequence
  Synthetic
acuggucuccaggccgaggggg

SEQ ID NO: 8543 - RNA, 23 nt, Artificial Sequence
  Synthetic
uacuggucuccaggccgaggggg

SEQ ID NO: 8544 - RNA, 24 nt, Artificial Sequence
  Synthetic
auacuggucuccaggccgaggggg

SEQ ID NO: 8545 - RNA, 18 nt, Artificial Sequence
  Synthetic
cccagguagagugugggg

SEQ ID NO: 8546 - RNA, 19 nt, Artificial Sequence
  Synthetic
ucccagguagagugugggg

SEQ ID NO: 8547 - RNA, 20 nt, Artificial Sequence
  Synthetic
aucccagguagagugugggg

SEQ ID NO: 8548 - RNA, 21 nt, Artificial Sequence
  Synthetic
caucccagguagagugugggg

SEQ ID NO: 8549 - RNA, 22 nt, Artificial Sequence
  Synthetic
acaucccagguagagugugggg

SEQ ID NO: 8550 - RNA, 23 nt, Artificial Sequence
  Synthetic
gacaucccagguagagugugggg

SEQ ID NO: 8551 - RNA, 24 nt, Artificial Sequence
  Synthetic
ugacaucccagguagagugugggg

SEQ ID NO: 8552 - RNA, 18 nt, Artificial Sequence
  Synthetic
guguggggaagggauggg

SEQ ID NO: 8553 - RNA, 19 nt, Artificial Sequence
  Synthetic
aguguggggaagggauggg

SEQ ID NO: 8554 - RNA, 21 nt, Artificial Sequence
  Synthetic
agaguguggggaagggauggg

SEQ ID NO: 8555 - RNA, 22 nt, Artificial Sequence
  Synthetic
uagaguguggggaagggauggg

SEQ ID NO: 8556 - RNA, 23 nt, Artificial Sequence
  Synthetic
guagaguguggggaagggauggg

SEQ ID NO: 8557 - RNA, 24 nt, Artificial Sequence
  Synthetic
gguagaguguggggaagggauggg

SEQ ID NO: 8558 - RNA, 18 nt, Artificial Sequence
  Synthetic
gaaagcacaguuccuggg

SEQ ID NO: 8559 - RNA, 19 nt, Artificial Sequence
  Synthetic
agaaagcacaguuccuggg

SEQ ID NO: 8560 - RNA, 20 nt, Artificial Sequence
  Synthetic
cagaaagcacaguuccuggg

SEQ ID NO: 8561 - RNA, 21 nt, Artificial Sequence
  Synthetic
acagaaagcacaguuccuggg

SEQ ID NO: 8562 - RNA, 22 nt, Artificial Sequence
  Synthetic
uacagaaagcacaguuccuggg

SEQ ID NO: 8563 - RNA, 23 nt, Artificial Sequence
  Synthetic
cuacagaaagcacaguuccuggg

SEQ ID NO: 8564 - RNA, 24 nt, Artificial Sequence
  Synthetic
acuacagaaagcacaguuccuggg

SEQ ID NO: 8565 - RNA, 18 nt, Artificial Sequence
  Synthetic
ugucugugguggagaugg

SEQ ID NO: 8566 - RNA, 19 nt, Artificial Sequence
  Synthetic
uugucugugguggagaugg

SEQ ID NO: 8567 - RNA, 20 nt, Artificial Sequence
  Synthetic
guugucugugguggagaugg

SEQ ID NO: 8568 - RNA, 21 nt, Artificial Sequence
  Synthetic
uguugucugugguggagaugg

SEQ ID NO: 8569 - RNA, 22 nt, Artificial Sequence
  Synthetic
guguugucugugguggagaugg

SEQ ID NO: 8570 - RNA, 23 nt, Artificial Sequence
  Synthetic
gguguugucugugguggagaugg

SEQ ID NO: 8571 - RNA, 24 nt, Artificial Sequence
  Synthetic
cgguguugucugugguggagaugg

SEQ ID NO: 8572 - RNA, 18 nt, Artificial Sequence
  Synthetic
aguguggggaagggaugg

SEQ ID NO: 8573 - RNA, 19 nt, Artificial Sequence
  Synthetic
gaguguggggaagggaugg

SEQ ID NO: 8574 - RNA, 20 nt, Artificial Sequence
  Synthetic
agaguguggggaagggaugg

SEQ ID NO: 8575 - RNA, 21 nt, Artificial Sequence
  Synthetic
uagaguguggggaagggaugg

SEQ ID NO: 8576 - RNA, 22 nt, Artificial Sequence
  Synthetic
guagaguguggggaagggaugg

SEQ ID NO: 8577 - RNA, 23 nt, Artificial Sequence
  Synthetic
gguagaguguggggaagggaugg

SEQ ID NO: 8578 - RNA, 24 nt, Artificial Sequence
  Synthetic
agguagaguguggggaagggaugg

SEQ ID NO: 8579 - RNA, 18 nt, Artificial Sequence
  Synthetic
aacccccagguggacugg

SEQ ID NO: 8580 - RNA, 19 nt, Artificial Sequence
  Synthetic
caacccccagguggacugg

SEQ ID NO: 8581 - RNA, 20 nt, Artificial Sequence
  Synthetic
acaacccccagguggacugg

SEQ ID NO: 8582 - RNA, 21 nt, Artificial Sequence
  Synthetic
aacaacccccagguggacugg

SEQ ID NO: 8583 - RNA, 22 nt, Artificial Sequence
  Synthetic
caacaacccccagguggacugg

SEQ ID NO: 8584 - RNA, 23 nt, Artificial Sequence
  Synthetic
acaacaacccccagguggacugg

SEQ ID NO: 8585 - RNA, 24 nt, Artificial Sequence
  Synthetic
gacaacaacccccagguggacugg

SEQ ID NO: 8586 - RNA, 18 nt, Artificial Sequence
  Synthetic
agacucugccaucccugg

SEQ ID NO: 8587 - RNA, 19 nt, Artificial Sequence
  Synthetic
gagacucugccaucccugg

SEQ ID NO: 8588 - RNA, 21 nt, Artificial Sequence
  Synthetic
cagagacucugccaucccugg

SEQ ID NO: 8589 - RNA, 22 nt, Artificial Sequence
  Synthetic
ccagagacucugccaucccugg

SEQ ID NO: 8590 - RNA, 23 nt, Artificial Sequence
  Synthetic
gccagagacucugccaucccugg

SEQ ID NO: 8591 - RNA, 24 nt, Artificial Sequence
  Synthetic
ugccagagacucugccaucccugg

SEQ ID NO: 8592 - RNA, 18 nt, Artificial Sequence
  Synthetic
acgguaggucgugccugg

SEQ ID NO: 8593 - RNA, 19 nt, Artificial Sequence
  Synthetic
cacgguaggucgugccugg

SEQ ID NO: 8594 - RNA, 20 nt, Artificial Sequence
  Synthetic
ucacgguaggucgugccugg

SEQ ID NO: 8595 - RNA, 21 nt, Artificial Sequence
  Synthetic
gucacgguaggucgugccugg

SEQ ID NO: 8596 - RNA, 22 nt, Artificial Sequence
  Synthetic
ugucacgguaggucgugccugg

SEQ ID NO: 8597 - RNA, 23 nt, Artificial Sequence
  Synthetic
cugucacgguaggucgugccugg

SEQ ID NO: 8598 - RNA, 24 nt, Artificial Sequence
  Synthetic
ucugucacgguaggucgugccugg

SEQ ID NO: 8599 - RNA, 18 nt, Artificial Sequence
  Synthetic
aaauuaaagaggagcugg

SEQ ID NO: 8600 - RNA, 19 nt, Artificial Sequence
  Synthetic
gaaauuaaagaggagcugg

SEQ ID NO: 8601 - RNA, 21 nt, Artificial Sequence
  Synthetic
cggaaauuaaagaggagcugg

SEQ ID NO: 8602 - RNA, 22 nt, Artificial Sequence
  Synthetic
ccggaaauuaaagaggagcugg

SEQ ID NO: 8603 - RNA, 23 nt, Artificial Sequence
  Synthetic
cccggaaauuaaagaggagcugg

SEQ ID NO: 8604 - RNA, 24 nt, Artificial Sequence
  Synthetic
acccggaaauuaaagaggagcugg

SEQ ID NO: 8605 - RNA, 18 nt, Artificial Sequence
  Synthetic
ccuccaccuguccucugg

SEQ ID NO: 8606 - RNA, 19 nt, Artificial Sequence
  Synthetic
uccuccaccuguccucugg

SEQ ID NO: 8607 - RNA, 21 nt, Artificial Sequence
  Synthetic
guuccuccaccuguccucugg

SEQ ID NO: 8608 - RNA, 22 nt, Artificial Sequence
  Synthetic
aguuccuccaccuguccucugg

SEQ ID NO: 8609 - RNA, 23 nt, Artificial Sequence
  Synthetic
caguuccuccaccuguccucugg

SEQ ID NO: 8610 - RNA, 24 nt, Artificial Sequence
  Synthetic
ccaguuccuccaccuguccucugg

SEQ ID NO: 8611 - RNA, 18 nt, Artificial Sequence
  Synthetic
ccucgguguugucugugg

SEQ ID NO: 8612 - RNA, 19 nt, Artificial Sequence
  Synthetic
uccucgguguugucugugg

SEQ ID NO: 8613 - RNA, 21 nt, Artificial Sequence
  Synthetic
gcuccucgguguugucugugg

SEQ ID NO: 8614 - RNA, 22 nt, Artificial Sequence
  Synthetic
ggcuccucgguguugucugugg

SEQ ID NO: 8615 - RNA, 23 nt, Artificial Sequence
  Synthetic
cggcuccucgguguugucugugg

SEQ ID NO: 8616 - RNA, 24 nt, Artificial Sequence
  Synthetic
ucggcuccucgguguugucugugg

SEQ ID NO: 8617 - RNA, 18 nt, Artificial Sequence
  Synthetic
gagaccuccaucagcaug

SEQ ID NO: 8618 - RNA, 19 nt, Artificial Sequence
  Synthetic
ggagaccuccaucagcaug

SEQ ID NO: 8619 - RNA, 21 nt, Artificial Sequence
  Synthetic
guggagaccuccaucagcaug

SEQ ID NO: 8620 - RNA, 22 nt, Artificial Sequence
  Synthetic
cguggagaccuccaucagcaug

SEQ ID NO: 8621 - RNA, 23 nt, Artificial Sequence
  Synthetic
gcguggagaccuccaucagcaug

SEQ ID NO: 8622 - RNA, 24 nt, Artificial Sequence
  Synthetic
ggcguggagaccuccaucagcaug

SEQ ID NO: 8623 - RNA, 18 nt, Artificial Sequence
  Synthetic
cgcagccgucgcgaccug

SEQ ID NO: 8624 - RNA, 19 nt, Artificial Sequence
  Synthetic
ccgcagccgucgcgaccug

SEQ ID NO: 8625 - RNA, 21 nt, Artificial Sequence
  Synthetic
ucccgcagccgucgcgaccug

SEQ ID NO: 8626 - RNA, 22 nt, Artificial Sequence
  Synthetic
cucccgcagccgucgcgaccug

SEQ ID NO: 8627 - RNA, 23 nt, Artificial Sequence
  Synthetic
gcucccgcagccgucgcgaccug

SEQ ID NO: 8628 - RNA, 24 nt, Artificial Sequence
  Synthetic
ggcucccgcagccgucgcgaccug

SEQ ID NO: 8629 - RNA, 18 nt, Artificial Sequence
  Synthetic
gagacucugccaucccug

SEQ ID NO: 8630 - RNA, 19 nt, Artificial Sequence
  Synthetic
agagacucugccaucccug

SEQ ID NO: 8631 - RNA, 20 nt, Artificial Sequence
  Synthetic
cagagacucugccaucccug

SEQ ID NO: 8632 - RNA, 21 nt, Artificial Sequence
  Synthetic
ccagagacucugccaucccug

SEQ ID NO: 8633 - RNA, 22 nt, Artificial Sequence
  Synthetic
gccagagacucugccaucccug

SEQ ID NO: 8634 - RNA, 23 nt, Artificial Sequence
  Synthetic
ugccagagacucugccaucccug

SEQ ID NO: 8635 - RNA, 24 nt, Artificial Sequence
  Synthetic
cugccagagacucugccaucccug

SEQ ID NO: 8636 - RNA, 18 nt, Artificial Sequence
  Synthetic
cacuacaucaacauccug

SEQ ID NO: 8637 - RNA, 19 nt, Artificial Sequence
  Synthetic
ccacuacaucaacauccug

SEQ ID NO: 8638 - RNA, 20 nt, Artificial Sequence
  Synthetic
uccacuacaucaacauccug

SEQ ID NO: 8639 - RNA, 21 nt, Artificial Sequence
  Synthetic
uuccacuacaucaacauccug

SEQ ID NO: 8640 - RNA, 22 nt, Artificial Sequence
  Synthetic
cuuccacuacaucaacauccug

SEQ ID NO: 8641 - RNA, 23 nt, Artificial Sequence
  Synthetic
gcuuccacuacaucaacauccug

SEQ ID NO: 8642 - RNA, 24 nt, Artificial Sequence
  Synthetic
cgcuuccacuacaucaacauccug

SEQ ID NO: 8643 - RNA, 18 nt, Artificial Sequence
  Synthetic
auggcagugauguuccug

SEQ ID NO: 8644 - RNA, 19 nt, Artificial Sequence
  Synthetic
aauggcagugauguuccug

SEQ ID NO: 8645 - RNA, 20 nt, Artificial Sequence
  Synthetic
gaauggcagugauguuccug

SEQ ID NO: 8646 - RNA, 21 nt, Artificial Sequence
  Synthetic
agaauggcagugauguuccug

SEQ ID NO: 8647 - RNA, 22 nt, Artificial Sequence
  Synthetic
aagaauggcagugauguuccug

SEQ ID NO: 8648 - RNA, 23 nt, Artificial Sequence
  Synthetic
caagaauggcagugauguuccug

SEQ ID NO: 8649 - RNA, 24 nt, Artificial Sequence
  Synthetic
ccaagaauggcagugauguuccug

SEQ ID NO: 8650 - RNA, 18 nt, Artificial Sequence
  Synthetic
aagaucggcuuccagcug

SEQ ID NO: 8651 - RNA, 19 nt, Artificial Sequence
  Synthetic
gaagaucggcuuccagcug

SEQ ID NO: 8652 - RNA, 20 nt, Artificial Sequence
  Synthetic
ggaagaucggcuuccagcug

SEQ ID NO: 8653 - RNA, 21 nt, Artificial Sequence
  Synthetic
uggaagaucggcuuccagcug

SEQ ID NO: 8654 - RNA, 22 nt, Artificial Sequence
  Synthetic
cuggaagaucggcuuccagcug

SEQ ID NO: 8655 - RNA, 23 nt, Artificial Sequence
  Synthetic
acuggaagaucggcuuccagcug

SEQ ID NO: 8656 - RNA, 24 nt, Artificial Sequence
  Synthetic
gacuggaagaucggcuuccagcug

SEQ ID NO: 8657 - RNA, 18 nt, Artificial Sequence
  Synthetic
gaaauuaaagaggagcug

SEQ ID NO: 8658 - RNA, 19 nt, Artificial Sequence
  Synthetic
ggaaauuaaagaggagcug

SEQ ID NO: 8659 - RNA, 20 nt, Artificial Sequence
  Synthetic
cggaaauuaaagaggagcug

SEQ ID NO: 8660 - RNA, 21 nt, Artificial Sequence
  Synthetic
ccggaaauuaaagaggagcug

SEQ ID NO: 8661 - RNA, 22 nt, Artificial Sequence
  Synthetic
cccggaaauuaaagaggagcug

SEQ ID NO: 8662 - RNA, 23 nt, Artificial Sequence
  Synthetic
acccggaaauuaaagaggagcug

SEQ ID NO: 8663 - RNA, 24 nt, Artificial Sequence
  Synthetic
uacccggaaauuaaagaggagcug

SEQ ID NO: 8664 - RNA, 18 nt, Artificial Sequence
  Synthetic
uccuccaccuguccucug

SEQ ID NO: 8665 - RNA, 19 nt, Artificial Sequence
  Synthetic
uuccuccaccuguccucug

SEQ ID NO: 8666 - RNA, 21 nt, Artificial Sequence
  Synthetic
aguuccuccaccuguccucug

SEQ ID NO: 8667 - RNA, 22 nt, Artificial Sequence
  Synthetic
caguuccuccaccuguccucug

SEQ ID NO: 8668 - RNA, 23 nt, Artificial Sequence
  Synthetic
ccaguuccuccaccuguccucug

SEQ ID NO: 8669 - RNA, 24 nt, Artificial Sequence
  Synthetic
gccaguuccuccaccuguccucug

SEQ ID NO: 8670 - RNA, 18 nt, Artificial Sequence
  Synthetic
caucuccagggggcucug

SEQ ID NO: 8671 - RNA, 19 nt, Artificial Sequence
  Synthetic
ccaucuccagggggcucug

SEQ ID NO: 8672 - RNA, 20 nt, Artificial Sequence
  Synthetic
cccaucuccagggggcucug

SEQ ID NO: 8673 - RNA, 21 nt, Artificial Sequence
  Synthetic
gcccaucuccagggggcucug

SEQ ID NO: 8674 - RNA, 22 nt, Artificial Sequence
  Synthetic
cgcccaucuccagggggcucug

SEQ ID NO: 8675 - RNA, 23 nt, Artificial Sequence
  Synthetic
ccgcccaucuccagggggcucug

SEQ ID NO: 8676 - RNA, 24 nt, Artificial Sequence
  Synthetic
cccgcccaucuccagggggcucug

SEQ ID NO: 8677 - RNA, 18 nt, Artificial Sequence
  Synthetic
gggcuguuucaccaagug

SEQ ID NO: 8678 - RNA, 19 nt, Artificial Sequence
  Synthetic
ugggcuguuucaccaagug

SEQ ID NO: 8679 - RNA, 20 nt, Artificial Sequence
  Synthetic
cugggcuguuucaccaagug

SEQ ID NO: 8680 - RNA, 21 nt, Artificial Sequence
  Synthetic
ccugggcuguuucaccaagug

SEQ ID NO: 8681 - RNA, 22 nt, Artificial Sequence
  Synthetic
accugggcuguuucaccaagug

SEQ ID NO: 8682 - RNA, 23 nt, Artificial Sequence
  Synthetic
caccugggcuguuucaccaagug

SEQ ID NO: 8683 - RNA, 24 nt, Artificial Sequence
  Synthetic
ccaccugggcuguuucaccaagug

SEQ ID NO: 8684 - RNA, 18 nt, Artificial Sequence
  Synthetic
gacaucccagguagagug

SEQ ID NO: 8685 - RNA, 19 nt, Artificial Sequence
  Synthetic
ugacaucccagguagagug

SEQ ID NO: 8686 - RNA, 21 nt, Artificial Sequence
  Synthetic
ggugacaucccagguagagug

SEQ ID NO: 8687 - RNA, 22 nt, Artificial Sequence
  Synthetic
cggugacaucccagguagagug

SEQ ID NO: 8688 - RNA, 23 nt, Artificial Sequence
  Synthetic
ucggugacaucccagguagagug

SEQ ID NO: 8689 - RNA, 24 nt, Artificial Sequence
  Synthetic
cucggugacaucccagguagagug

SEQ ID NO: 8690 - RNA, 18 nt, Artificial Sequence
  Synthetic
ucagggguggaugcggug

SEQ ID NO: 8691 - RNA, 19 nt, Artificial Sequence
  Synthetic
aucagggguggaugcggug

SEQ ID NO: 8692 - RNA, 21 nt, Artificial Sequence
  Synthetic
ucaucagggguggaugcggug

SEQ ID NO: 8693 - RNA, 22 nt, Artificial Sequence
  Synthetic
cucaucagggguggaugcggug

SEQ ID NO: 8694 - RNA, 23 nt, Artificial Sequence
  Synthetic
acucaucagggguggaugcggug

SEQ ID NO: 8695 - RNA, 24 nt, Artificial Sequence
  Synthetic
uacucaucagggguggaugcggug

SEQ ID NO: 8696 - RNA, 18 nt, Artificial Sequence
  Synthetic
uccucgguguugucugug

SEQ ID NO: 8697 - RNA, 19 nt, Artificial Sequence
  Synthetic
cuccucgguguugucugug

SEQ ID NO: 8698 - RNA, 20 nt, Artificial Sequence
  Synthetic
gcuccucgguguugucugug

SEQ ID NO: 8699 - RNA, 21 nt, Artificial Sequence
  Synthetic
ggcuccucgguguugucugug

SEQ ID NO: 8700 - RNA, 22 nt, Artificial Sequence
  Synthetic
cggcuccucgguguugucugug

SEQ ID NO: 8701 - RNA, 23 nt, Artificial Sequence
  Synthetic
ucggcuccucgguguugucugug

SEQ ID NO: 8702 - RNA, 24 nt, Artificial Sequence
  Synthetic
uucggcuccucgguguugucugug

SEQ ID NO: 8703 - RNA, 18 nt, Artificial Sequence
  Synthetic
caucccagguagagugug

SEQ ID NO: 8704 - RNA, 19 nt, Artificial Sequence
  Synthetic
acaucccagguagagugug

SEQ ID NO: 8705 - RNA, 21 nt, Artificial Sequence
  Synthetic
ugacaucccagguagagugug

SEQ ID NO: 8706 - RNA, 22 nt, Artificial Sequence
  Synthetic
gugacaucccagguagagugug

SEQ ID NO: 8707 - RNA, 23 nt, Artificial Sequence
  Synthetic
ggugacaucccagguagagugug

SEQ ID NO: 8708 - RNA, 24 nt, Artificial Sequence
  Synthetic
cggugacaucccagguagagugug

SEQ ID NO: 8709 - RNA, 18 nt, Artificial Sequence
  Synthetic
agcguggccuccagcuug

SEQ ID NO: 8710 - RNA, 19 nt, Artificial Sequence
  Synthetic
uagcguggccuccagcuug

SEQ ID NO: 8711 - RNA, 21 nt, Artificial Sequence
  Synthetic
cguagcguggccuccagcuug

SEQ ID NO: 8712 - RNA, 22 nt, Artificial Sequence
  Synthetic
ccguagcguggccuccagcuug

SEQ ID NO: 8713 - RNA, 23 nt, Artificial Sequence
  Synthetic
cccguagcguggccuccagcuug

SEQ ID NO: 8714 - RNA, 24 nt, Artificial Sequence
  Synthetic
gcccguagcguggccuccagcuug

SEQ ID NO: 8715 - RNA, 18 nt, Artificial Sequence
  Synthetic
ggagaccuccaucagcau

SEQ ID NO: 8716 - RNA, 19 nt, Artificial Sequence
  Synthetic
uggagaccuccaucagcau

SEQ ID NO: 8717 - RNA, 20 nt, Artificial Sequence
  Synthetic
guggagaccuccaucagcau

SEQ ID NO: 8718 - RNA, 21 nt, Artificial Sequence
  Synthetic
cguggagaccuccaucagcau

SEQ ID NO: 8719 - RNA, 22 nt, Artificial Sequence
  Synthetic
gcguggagaccuccaucagcau

SEQ ID NO: 8720 - RNA, 23 nt, Artificial Sequence
  Synthetic
ggcguggagaccuccaucagcau

SEQ ID NO: 8721 - RNA, 24 nt, Artificial Sequence
  Synthetic
uggcguggagaccuccaucagcau

SEQ ID NO: 8722 - RNA, 18 nt, Artificial Sequence
  Synthetic
ucuaccagacauacucau

SEQ ID NO: 8723 - RNA, 19 nt, Artificial Sequence
  Synthetic
uucuaccagacauacucau

SEQ ID NO: 8724 - RNA, 20 nt, Artificial Sequence
  Synthetic
cuucuaccagacauacucau

SEQ ID NO: 8725 - RNA, 21 nt, Artificial Sequence
  Synthetic
gcuucuaccagacauacucau

SEQ ID NO: 8726 - RNA, 22 nt, Artificial Sequence
  Synthetic
ugcuucuaccagacauacucau

SEQ ID NO: 8727 - RNA, 23 nt, Artificial Sequence
  Synthetic
cugcuucuaccagacauacucau

SEQ ID NO: 8728 - RNA, 24 nt, Artificial Sequence
  Synthetic
acugcuucuaccagacauacucau

SEQ ID NO: 8729 - RNA, 18 nt, Artificial Sequence
  Synthetic
ugguguauguggguucau

SEQ ID NO: 8730 - RNA, 19 nt, Artificial Sequence
  Synthetic
uugguguauguggguucau

SEQ ID NO: 8731 - RNA, 21 nt, Artificial Sequence
  Synthetic
ucuugguguauguggguucau

SEQ ID NO: 8732 - RNA, 22 nt, Artificial Sequence
  Synthetic
cucuugguguauguggguucau

SEQ ID NO: 8733 - RNA, 23 nt, Artificial Sequence
  Synthetic
ucucuugguguauguggguucau

SEQ ID NO: 8734 - RNA, 24 nt, Artificial Sequence
  Synthetic
aucucuugguguauguggguucau

SEQ ID NO: 8735 - RNA, 18 nt, Artificial Sequence
  Synthetic
uacucucucuuuccugau

SEQ ID NO: 8736 - RNA, 19 nt, Artificial Sequence
  Synthetic
cuacucucucuuuccugau

SEQ ID NO: 8737 - RNA, 20 nt, Artificial Sequence
  Synthetic
ccuacucucucuuuccugau

SEQ ID NO: 8738 - RNA, 21 nt, Artificial Sequence
  Synthetic
cccuacucucucuuuccugau

SEQ ID NO: 8739 - RNA, 22 nt, Artificial Sequence
  Synthetic
acccuacucucucuuuccugau

SEQ ID NO: 8740 - RNA, 23 nt, Artificial Sequence
  Synthetic
gacccuacucucucuuuccugau

SEQ ID NO: 8741 - RNA, 24 nt, Artificial Sequence
  Synthetic
ugacccuacucucucuuuccugau

SEQ ID NO: 8742 - RNA, 18 nt, Artificial Sequence
  Synthetic
ggaaacccuggacagacu

SEQ ID NO: 8743 - RNA, 19 nt, Artificial Sequence
  Synthetic
aggaaacccuggacagacu

SEQ ID NO: 8744 - RNA, 21 nt, Artificial Sequence
  Synthetic
auaggaaacccuggacagacu

SEQ ID NO: 8745 - RNA, 22 nt, Artificial Sequence
  Synthetic
cauaggaaacccuggacagacu

SEQ ID NO: 8746 - RNA, 23 nt, Artificial Sequence
  Synthetic
ucauaggaaacccuggacagacu

SEQ ID NO: 8747 - RNA, 24 nt, Artificial Sequence
  Synthetic
uucauaggaaacccuggacagacu

SEQ ID NO: 8748 - RNA, 18 nt, Artificial Sequence
  Synthetic
aaggcaaggaugcugacu

SEQ ID NO: 8749 - RNA, 19 nt, Artificial Sequence
  Synthetic
gaaggcaaggaugcugacu

SEQ ID NO: 8750 - RNA, 21 nt, Artificial Sequence
  Synthetic
aggaaggcaaggaugcugacu

SEQ ID NO: 8751 - RNA, 22 nt, Artificial Sequence
  Synthetic
gaggaaggcaaggaugcugacu

SEQ ID NO: 8752 - RNA, 23 nt, Artificial Sequence
  Synthetic
ugaggaaggcaaggaugcugacu

SEQ ID NO: 8753 - RNA, 24 nt, Artificial Sequence
  Synthetic
augaggaaggcaaggaugcugacu

SEQ ID NO: 8754 - RNA, 18 nt, Artificial Sequence
  Synthetic
acccucugccccacaccu

SEQ ID NO: 8755 - RNA, 19 nt, Artificial Sequence
  Synthetic
cacccucugccccacaccu

SEQ ID NO: 8756 - RNA, 20 nt, Artificial Sequence
  Synthetic
ccacccucugccccacaccu

SEQ ID NO: 8757 - RNA, 21 nt, Artificial Sequence
  Synthetic
cccacccucugccccacaccu

SEQ ID NO: 8758 - RNA, 22 nt, Artificial Sequence
  Synthetic
ucccacccucugccccacaccu

SEQ ID NO: 8759 - RNA, 23 nt, Artificial Sequence
  Synthetic
uucccacccucugccccacaccu

SEQ ID NO: 8760 - RNA, 24 nt, Artificial Sequence
  Synthetic
cuucccacccucugccccacaccu

SEQ ID NO: 8761 - RNA, 18 nt, Artificial Sequence
  Synthetic
ccgcagccgucgcgaccu

SEQ ID NO: 8762 - RNA, 19 nt, Artificial Sequence
  Synthetic
cccgcagccgucgcgaccu

SEQ ID NO: 8763 - RNA, 20 nt, Artificial Sequence
  Synthetic
ucccgcagccgucgcgaccu

SEQ ID NO: 8764 - RNA, 21 nt, Artificial Sequence
  Synthetic
cucccgcagccgucgcgaccu

SEQ ID NO: 8765 - RNA, 22 nt, Artificial Sequence
  Synthetic
gcucccgcagccgucgcgaccu

SEQ ID NO: 8766 - RNA, 23 nt, Artificial Sequence
  Synthetic
ggcucccgcagccgucgcgaccu

SEQ ID NO: 8767 - RNA, 24 nt, Artificial Sequence
  Synthetic
cggcucccgcagccgucgcgaccu

SEQ ID NO: 8768 - RNA, 18 nt, Artificial Sequence
  Synthetic
guccucugggggggcccu

SEQ ID NO: 8769 - RNA, 19 nt, Artificial Sequence
  Synthetic
uguccucugggggggcccu

SEQ ID NO: 8770 - RNA, 20 nt, Artificial Sequence
  Synthetic
cuguccucugggggggcccu

SEQ ID NO: 8771 - RNA, 21 nt, Artificial Sequence
  Synthetic
ccuguccucugggggggcccu

SEQ ID NO: 8772 - RNA, 22 nt, Artificial Sequence
  Synthetic
accuguccucugggggggcccu

SEQ ID NO: 8773 - RNA, 23 nt, Artificial Sequence
  Synthetic
caccuguccucugggggggcccu

SEQ ID NO: 8774 - RNA, 24 nt, Artificial Sequence
  Synthetic
ccaccuguccucugggggggcccu

SEQ ID NO: 8775 - RNA, 18 nt, Artificial Sequence
  Synthetic
aguuccuccaccuguccu

SEQ ID NO: 8776 - RNA, 19 nt, Artificial Sequence
  Synthetic
caguuccuccaccuguccu

SEQ ID NO: 8777 - RNA, 20 nt, Artificial Sequence
  Synthetic
ccaguuccuccaccuguccu

SEQ ID NO: 8778 - RNA, 21 nt, Artificial Sequence
  Synthetic
gccaguuccuccaccuguccu

SEQ ID NO: 8779 - RNA, 22 nt, Artificial Sequence
  Synthetic
ggccaguuccuccaccuguccu

SEQ ID NO: 8780 - RNA, 23 nt, Artificial Sequence
  Synthetic
gggccaguuccuccaccuguccu

SEQ ID NO: 8781 - RNA, 24 nt, Artificial Sequence
  Synthetic
ggggccaguuccuccaccuguccu

SEQ ID NO: 8782 - RNA, 18 nt, Artificial Sequence
  Synthetic
cauguuccucaugcugcu

SEQ ID NO: 8783 - RNA, 19 nt, Artificial Sequence
  Synthetic
ucauguuccucaugcugcu

SEQ ID NO: 8784 - RNA, 20 nt, Artificial Sequence
  Synthetic
aucauguuccucaugcugcu

SEQ ID NO: 8785 - RNA, 21 nt, Artificial Sequence
  Synthetic
caucauguuccucaugcugcu

SEQ ID NO: 8786 - RNA, 22 nt, Artificial Sequence
  Synthetic
ucaucauguuccucaugcugcu

SEQ ID NO: 8787 - RNA, 23 nt, Artificial Sequence
  Synthetic
gucaucauguuccucaugcugcu

SEQ ID NO: 8788 - RNA, 24 nt, Artificial Sequence
  Synthetic
ggucaucauguuccucaugcugcu

SEQ ID NO: 8789 - RNA, 18 nt, Artificial Sequence
  Synthetic
cgagggggcaggggugcu

SEQ ID NO: 8790 - RNA, 19 nt, Artificial Sequence
  Synthetic
ccgagggggcaggggugcu

SEQ ID NO: 8791 - RNA, 20 nt, Artificial Sequence
  Synthetic
gccgagggggcaggggugcu

SEQ ID NO: 8792 - RNA, 21 nt, Artificial Sequence
  Synthetic
ggccgagggggcaggggugcu

SEQ ID NO: 8793 - RNA, 22 nt, Artificial Sequence
  Synthetic
aggccgagggggcaggggugcu

SEQ ID NO: 8794 - RNA, 23 nt, Artificial Sequence
  Synthetic
caggccgagggggcaggggugcu

SEQ ID NO: 8795 - RNA, 24 nt, Artificial Sequence
  Synthetic
ccaggccgagggggcaggggugcu

SEQ ID NO: 8796 - RNA, 18 nt, Artificial Sequence
  Synthetic
uuccuccaccuguccucu

SEQ ID NO: 8797 - RNA, 19 nt, Artificial Sequence
  Synthetic
guuccuccaccuguccucu

SEQ ID NO: 8798 - RNA, 21 nt, Artificial Sequence
  Synthetic
caguuccuccaccuguccucu

SEQ ID NO: 8799 - RNA, 22 nt, Artificial Sequence
  Synthetic
ccaguuccuccaccuguccucu

SEQ ID NO: 8800 - RNA, 23 nt, Artificial Sequence
  Synthetic
gccaguuccuccaccuguccucu

SEQ ID NO: 8801 - RNA, 24 nt, Artificial Sequence
  Synthetic
ggccaguuccuccaccuguccucu

SEQ ID NO: 8802 - RNA, 18 nt, Artificial Sequence
  Synthetic
ugacaucccagguagagu

SEQ ID NO: 8803 - RNA, 19 nt, Artificial Sequence
  Synthetic
gugacaucccagguagagu

SEQ ID NO: 8804 - RNA, 20 nt, Artificial Sequence
  Synthetic
ggugacaucccagguagagu

SEQ ID NO: 8805 - RNA, 21 nt, Artificial Sequence
  Synthetic
cggugacaucccagguagagu

SEQ ID NO: 8806 - RNA, 22 nt, Artificial Sequence
  Synthetic
ucggugacaucccagguagagu

SEQ ID NO: 8807 - RNA, 23 nt, Artificial Sequence
  Synthetic
cucggugacaucccagguagagu

SEQ ID NO: 8808 - RNA, 24 nt, Artificial Sequence
  Synthetic
ccucggugacaucccagguagagu

SEQ ID NO: 8809 - RNA, 18 nt, Artificial Sequence
  Synthetic
ccuggaaucaacaacggu

SEQ ID NO: 8810 - RNA, 19 nt, Artificial Sequence
  Synthetic
gccuggaaucaacaacggu

SEQ ID NO: 8811 - RNA, 20 nt, Artificial Sequence
  Synthetic
ugccuggaaucaacaacggu

SEQ ID NO: 8812 - RNA, 21 nt, Artificial Sequence
  Synthetic
augccuggaaucaacaacggu

SEQ ID NO: 8813 - RNA, 22 nt, Artificial Sequence
  Synthetic
caugccuggaaucaacaacggu

SEQ ID NO: 8814 - RNA, 23 nt, Artificial Sequence
  Synthetic
ccaugccuggaaucaacaacggu

SEQ ID NO: 8815 - RNA, 24 nt, Artificial Sequence
  Synthetic
uccaugccuggaaucaacaacggu

SEQ ID NO: 8816 - RNA, 18 nt, Artificial Sequence
  Synthetic
aucagggguggaugcggu

SEQ ID NO: 8817 - RNA, 19 nt, Artificial Sequence
  Synthetic
caucagggguggaugcggu

SEQ ID NO: 8818 - RNA, 20 nt, Artificial Sequence
  Synthetic
ucaucagggguggaugcggu

SEQ ID NO: 8819 - RNA, 21 nt, Artificial Sequence
  Synthetic
cucaucagggguggaugcggu

SEQ ID NO: 8820 - RNA, 22 nt, Artificial Sequence
  Synthetic
acucaucagggguggaugcggu

SEQ ID NO: 8821 - RNA, 23 nt, Artificial Sequence
  Synthetic
uacucaucagggguggaugcggu

SEQ ID NO: 8822 - RNA, 24 nt, Artificial Sequence
  Synthetic
auacucaucagggguggaugcggu

SEQ ID NO: 8823 - RNA, 18 nt, Artificial Sequence
  Synthetic
uguggggaagggaugggu

SEQ ID NO: 8824 - RNA, 19 nt, Artificial Sequence
  Synthetic
guguggggaagggaugggu

SEQ ID NO: 8825 - RNA, 21 nt, Artificial Sequence
  Synthetic
gaguguggggaagggaugggu

SEQ ID NO: 8826 - RNA, 22 nt, Artificial Sequence
  Synthetic
agaguguggggaagggaugggu

SEQ ID NO: 8827 - RNA, 23 nt, Artificial Sequence
  Synthetic
uagaguguggggaagggaugggu

SEQ ID NO: 8828 - RNA, 24 nt, Artificial Sequence
  Synthetic
guagaguguggggaagggaugggu

SEQ ID NO: 8829 - RNA, 18 nt, Artificial Sequence
  Synthetic
acuuccaccacccgaugu

SEQ ID NO: 8830 - RNA, 19 nt, Artificial Sequence
  Synthetic
cacuuccaccacccgaugu

SEQ ID NO: 8831 - RNA, 20 nt, Artificial Sequence
  Synthetic
ucacuuccaccacccgaugu

SEQ ID NO: 8832 - RNA, 21 nt, Artificial Sequence
  Synthetic
cucacuuccaccacccgaugu

SEQ ID NO: 8833 - RNA, 22 nt, Artificial Sequence
  Synthetic
ucucacuuccaccacccgaugu

SEQ ID NO: 8834 - RNA, 23 nt, Artificial Sequence
  Synthetic
cucucacuuccaccacccgaugu

SEQ ID NO: 8835 - RNA, 24 nt, Artificial Sequence
  Synthetic
acucucacuuccaccacccgaugu

SEQ ID NO: 8836 - RNA, 18 nt, Artificial Sequence
  Synthetic
acaucccagguagagugu

SEQ ID NO: 8837 - RNA, 19 nt, Artificial Sequence
  Synthetic
gacaucccagguagagugu

SEQ ID NO: 8838 - RNA, 21 nt, Artificial Sequence
  Synthetic
gugacaucccagguagagugu

SEQ ID NO: 8839 - RNA, 22 nt, Artificial Sequence
  Synthetic
ggugacaucccagguagagugu

SEQ ID NO: 8840 - RNA, 23 nt, Artificial Sequence
  Synthetic
cggugacaucccagguagagugu

SEQ ID NO: 8841 - RNA, 24 nt, Artificial Sequence
  Synthetic
ucggugacaucccagguagagugu

SEQ ID NO: 8842 - RNA, 18 nt, Artificial Sequence
  Synthetic
gaaacccuggacagacuu

SEQ ID NO: 8843 - RNA, 19 nt, Artificial Sequence
  Synthetic
ggaaacccuggacagacuu

SEQ ID NO: 8844 - RNA, 21 nt, Artificial Sequence
  Synthetic
uaggaaacccuggacagacuu

SEQ ID NO: 8845 - RNA, 22 nt, Artificial Sequence
  Synthetic
auaggaaacccuggacagacuu

SEQ ID NO: 8846 - RNA, 23 nt, Artificial Sequence
  Synthetic
cauaggaaacccuggacagacuu

SEQ ID NO: 8847 - RNA, 24 nt, Artificial Sequence
  Synthetic
ucauaggaaacccuggacagacuu

SEQ ID NO: 8848 - RNA, 18 nt, Artificial Sequence
  Synthetic
uagcguggccuccagcuu

SEQ ID NO: 8849 - RNA, 19 nt, Artificial Sequence
  Synthetic
guagcguggccuccagcuu

SEQ ID NO: 8850 - RNA, 20 nt, Artificial Sequence
  Synthetic
cguagcguggccuccagcuu

SEQ ID NO: 8851 - RNA, 21 nt, Artificial Sequence
  Synthetic
ccguagcguggccuccagcuu

SEQ ID NO: 8852 - RNA, 22 nt, Artificial Sequence
  Synthetic
cccguagcguggccuccagcuu

SEQ ID NO: 8853 - RNA, 23 nt, Artificial Sequence
  Synthetic
gcccguagcguggccuccagcuu

SEQ ID NO: 8854 - RNA, 24 nt, Artificial Sequence
  Synthetic
agcccguagcguggccuccagcuu

SEQ ID NO: 8855 - RNA, 18 nt, Artificial Sequence
  Synthetic
caugcugcuccgaagguu

SEQ ID NO: 8856 - RNA, 19 nt, Artificial Sequence
  Synthetic
ucaugcugcuccgaagguu

SEQ ID NO: 8857 - RNA, 20 nt, Artificial Sequence
  Synthetic
cucaugcugcuccgaagguu

SEQ ID NO: 8858 - RNA, 21 nt, Artificial Sequence
  Synthetic
ccucaugcugcuccgaagguu

SEQ ID NO: 8859 - RNA, 22 nt, Artificial Sequence
  Synthetic
uccucaugcugcuccgaagguu

SEQ ID NO: 8860 - RNA, 23 nt, Artificial Sequence
  Synthetic
uuccucaugcugcuccgaagguu

SEQ ID NO: 8861 - RNA, 24 nt, Artificial Sequence
  Synthetic
guuccucaugcugcuccgaagguu

SEQ ID NO: 8862 - RNA, 18 nt, Artificial Sequence
  Synthetic
ggcagugauguuccuguu

SEQ ID NO: 8863 - RNA, 19 nt, Artificial Sequence
  Synthetic
uggcagugauguuccuguu

SEQ ID NO: 8864 - RNA, 20 nt, Artificial Sequence
  Synthetic
auggcagugauguuccuguu

SEQ ID NO: 8865 - RNA, 21 nt, Artificial Sequence
  Synthetic
aauggcagugauguuccuguu

SEQ ID NO: 8866 - RNA, 22 nt, Artificial Sequence
  Synthetic
gaauggcagugauguuccuguu

SEQ ID NO: 8867 - RNA, 23 nt, Artificial Sequence
  Synthetic
agaauggcagugauguuccuguu

SEQ ID NO: 8868 - RNA, 24 nt, Artificial Sequence
  Synthetic
aagaauggcagugauguuccuguu

SEQ ID NO: 8869 - RNA, 17 nt, Artificial Sequence
  Synthetic
ggcuagaguccugcucc

SEQ ID NO: 8870 - RNA, 17 nt, Artificial Sequence
  Synthetic
gucuaggguccugcucc

SEQ ID NO: 8871 - RNA, 17 nt, Artificial Sequence
  Synthetic
gauuccaaaccagguuc

SEQ ID NO: 8872 - RNA, 17 nt, Artificial Sequence
  Synthetic
gauguacuggcaauucg

SEQ ID NO: 8873 - RNA, 17 nt, Artificial Sequence
  Synthetic
cccuucaugagccccgg

SEQ ID NO: 8874 - RNA, 17 nt, Artificial Sequence
  Synthetic
agggacuaaccgaccug

SEQ ID NO: 8875 - RNA, 20 nt, Artificial Sequence
  Synthetic
caugauguacuggcaauucg

SEQ ID NO: 8876 - RNA, 20 nt, Artificial Sequence
  Synthetic
uuccccuucaugagccccgg

SEQ ID NO: 8877 - RNA, 17 nt, Artificial Sequence
  Synthetic
ggcccagccccugcucc

SEQ ID NO: 8878 - RNA, 20 nt, Artificial Sequence
  Synthetic
gagggcuagaguccugcucc

SEQ ID NO: 8879 - RNA, 20 nt, Artificial Sequence
  Synthetic
gaggucuaggguccugcucc

SEQ ID NO: 8880 - RNA, 20 nt, Artificial Sequence
  Synthetic
cggggcccagccccugcucc

SEQ ID NO: 8881 - RNA, 20 nt, Artificial Sequence
  Synthetic
caggauuccaaaccagguuc

SEQ ID NO: 8882 - RNA, 17 nt, Artificial Sequence
  Synthetic
gagucucaccccaggaa

SEQ ID NO: 8883 - RNA, 17 nt, Artificial Sequence
  Synthetic
acagcaggugaggccca

SEQ ID NO: 8884 - RNA, 17 nt, Artificial Sequence
  Synthetic
uaugucugguagaagca

SEQ ID NO: 8885 - RNA, 17 nt, Artificial Sequence
  Synthetic
uccagguguguauucac

SEQ ID NO: 8886 - RNA, 17 nt, Artificial Sequence
  Synthetic
gcuugcuccauggcgcc

SEQ ID NO: 8887 - RNA, 17 nt, Artificial Sequence
  Synthetic
gcaacuucaucuucgcc

SEQ ID NO: 8888 - RNA, 17 nt, Artificial Sequence
  Synthetic
gagcccguagcguggcc

SEQ ID NO: 8889 - RNA, 17 nt, Artificial Sequence
  Synthetic
acuggaaggacuggaag

SEQ ID NO: 8890 - RNA, 17 nt, Artificial Sequence
  Synthetic
gcaaccagaacaaaucg

SEQ ID NO: 8891 - RNA, 17 nt, Artificial Sequence
  Synthetic
augcggugagggagugg

SEQ ID NO: 8892 - RNA, 17 nt, Artificial Sequence
  Synthetic
aaggggacacuaaccug

SEQ ID NO: 8893 - RNA, 17 nt, Artificial Sequence
  Synthetic
cugccuuuauggaugau

SEQ ID NO: 8894 - RNA, 17 nt, Artificial Sequence
  Synthetic
aacaacggugagaagcu

SEQ ID NO: 8895 - RNA, 17 nt, Artificial Sequence
  Synthetic
ucggccuggagaccagu

SEQ ID NO: 8896 - RNA, 17 nt, Artificial Sequence
  Synthetic
agggagcuucucaccgu

SEQ ID NO: 8897 - RNA, 20 nt, Artificial Sequence
  Synthetic
cuggagucucaccccaggaa

SEQ ID NO: 8898 - RNA, 20 nt, Artificial Sequence
  Synthetic
cacacagcaggugaggccca

SEQ ID NO: 8899 - RNA, 20 nt, Artificial Sequence
  Synthetic
gaguaugucugguagaagca

SEQ ID NO: 8900 - RNA, 20 nt, Artificial Sequence
  Synthetic
ccuuccagguguguauucac

SEQ ID NO: 8901 - RNA, 20 nt, Artificial Sequence
  Synthetic
ccugcuugcuccauggcgcc

SEQ ID NO: 8902 - RNA, 20 nt, Artificial Sequence
  Synthetic
ugggcaacuucaucuucgcc

SEQ ID NO: 8903 - RNA, 20 nt, Artificial Sequence
  Synthetic
gucgagcccguagcguggcc

SEQ ID NO: 8904 - RNA, 20 nt, Artificial Sequence
  Synthetic
uggacuggaaggacuggaag

SEQ ID NO: 8905 - RNA, 20 nt, Artificial Sequence
  Synthetic
agugcaaccagaacaaaucg

SEQ ID NO: 8906 - RNA, 20 nt, Artificial Sequence
  Synthetic
uggaugcggugagggagugg

SEQ ID NO: 8907 - RNA, 20 nt, Artificial Sequence
  Synthetic
gggaaggggacacuaaccug

SEQ ID NO: 8908 - RNA, 20 nt, Artificial Sequence
  Synthetic
aaccugccuuuauggaugau

SEQ ID NO: 8909 - RNA, 20 nt, Artificial Sequence
  Synthetic
aucaacaacggugagaagcu

SEQ ID NO: 8910 - RNA, 20 nt, Artificial Sequence
  Synthetic
cccucggccuggagaccagu

SEQ ID NO: 8911 - RNA, 20 nt, Artificial Sequence
  Synthetic
agcagggagcuucucaccgu

SEQ ID NO: 8912 - RNA, 17 nt, Artificial Sequence
  Synthetic
gagaaucagacccaaaa

SEQ ID NO: 8913 - RNA, 17 nt, Artificial Sequence
  Synthetic
gagcuggcaaauagaaa

SEQ ID NO: 8914 - RNA, 17 nt, Artificial Sequence
  Synthetic
gaaggagccagcaccaa

SEQ ID NO: 8915 - RNA, 17 nt, Artificial Sequence
  Synthetic
gggcaacacaaggagaa

SEQ ID NO: 8916 - RNA, 17 nt, Artificial Sequence
  Synthetic
gcugggcuucccuagaa

SEQ ID NO: 8917 - RNA, 17 nt, Artificial Sequence
  Synthetic
gccagauucaacuggaa

SEQ ID NO: 8918 - RNA, 17 nt, Artificial Sequence
  Synthetic
gcuaggagggcaacaca

SEQ ID NO: 8919 - RNA, 17 nt, Artificial Sequence
  Synthetic
gaaacugacccuuccca

SEQ ID NO: 8920 - RNA, 17 nt, Artificial Sequence
  Synthetic
gagagcagacgaaucca

SEQ ID NO: 8921 - RNA, 17 nt, Artificial Sequence
  Synthetic
gugccaaguggugagca

SEQ ID NO: 8922 - RNA, 17 nt, Artificial Sequence
  Synthetic
gguccuuacauugggca

SEQ ID NO: 8923 - RNA, 17 nt, Artificial Sequence
  Synthetic
gaaagguggcccuauca

SEQ ID NO: 8924 - RNA, 17 nt, Artificial Sequence
  Synthetic
gcaguacuccaggcuca

SEQ ID NO: 8925 - RNA, 17 nt, Artificial Sequence
  Synthetic
gacacagcucgagguca

SEQ ID NO: 8926 - RNA, 17 nt, Artificial Sequence
  Synthetic
gaguacuggaccugaga

SEQ ID NO: 8927 - RNA, 17 nt, Artificial Sequence
  Synthetic
gagggccuagagugaga

SEQ ID NO: 8928 - RNA, 17 nt, Artificial Sequence
  Synthetic
ggaaggagggcucccga

SEQ ID NO: 8929 - RNA, 17 nt, Artificial Sequence
  Synthetic
gggaguuuuccgaagga

SEQ ID NO: 8930 - RNA, 17 nt, Artificial Sequence
  Synthetic
guuuuccgaaggaagga

SEQ ID NO: 8931 - RNA, 17 nt, Artificial Sequence
  Synthetic
gaaccgggaggacagga

SEQ ID NO: 8932 - RNA, 17 nt, Artificial Sequence
  Synthetic
ggagucugucuccagga

SEQ ID NO: 8933 - RNA, 17 nt, Artificial Sequence
  Synthetic
ggaugugaaagccggga

SEQ ID NO: 8934 - RNA, 17 nt, Artificial Sequence
  Synthetic
gucugcuggcuugugga

SEQ ID NO: 8935 - RNA, 17 nt, Artificial Sequence
  Synthetic
gucuggacaagguugga

SEQ ID NO: 8936 - RNA, 17 nt, Artificial Sequence
  Synthetic
gcucugugugggaguga

SEQ ID NO: 8937 - RNA, 17 nt, Artificial Sequence
  Synthetic
gaggagaaauucguuga

SEQ ID NO: 8938 - RNA, 17 nt, Artificial Sequence
  Synthetic
gaggagaggccguucua

SEQ ID NO: 8939 - RNA, 17 nt, Artificial Sequence
  Synthetic
ggagacuggaguuucua

SEQ ID NO: 8940 - RNA, 17 nt, Artificial Sequence
  Synthetic
ggaccaugcccaaugua

SEQ ID NO: 8941 - RNA, 17 nt, Artificial Sequence
  Synthetic
ggaauccugguugacac

SEQ ID NO: 8942 - RNA, 17 nt, Artificial Sequence
  Synthetic
ggcugccgcuuccucac

SEQ ID NO: 8943 - RNA, 17 nt, Artificial Sequence
  Synthetic
gggcuuuagacgcagac

SEQ ID NO: 8944 - RNA, 17 nt, Artificial Sequence
  Synthetic
gaaagccggugucaacc

SEQ ID NO: 8945 - RNA, 17 nt, Artificial Sequence
  Synthetic
gagcauugauacacacc

SEQ ID NO: 8946 - RNA, 17 nt, Artificial Sequence
  Synthetic
gauucugucucugcccc

SEQ ID NO: 8947 - RNA, 17 nt, Artificial Sequence
  Synthetic
gggcgggcuccccagcc

SEQ ID NO: 8948 - RNA, 17 nt, Artificial Sequence
  Synthetic
gcugagccucuagcucc

SEQ ID NO: 8949 - RNA, 17 nt, Artificial Sequence
  Synthetic
gggcgauuacacauucc

SEQ ID NO: 8950 - RNA, 17 nt, Artificial Sequence
  Synthetic
gucccaagugugcuucc

SEQ ID NO: 8951 - RNA, 17 nt, Artificial Sequence
  Synthetic
gguggcgaggaaucagc

SEQ ID NO: 8952 - RNA, 17 nt, Artificial Sequence
  Synthetic
gccaaaagugccggagc

SEQ ID NO: 8953 - RNA, 17 nt, Artificial Sequence
  Synthetic
gaggauguggccagcgc

SEQ ID NO: 8954 - RNA, 17 nt, Artificial Sequence
  Synthetic
gaagcugggggcuaggc

SEQ ID NO: 8955 - RNA, 17 nt, Artificial Sequence
  Synthetic
gaaggcggacucugggc

SEQ ID NO: 8956 - RNA, 17 nt, Artificial Sequence
  Synthetic
ggagcccgcccgcuggc

SEQ ID NO: 8957 - RNA, 17 nt, Artificial Sequence
  Synthetic
gccuaggggcucacugc

SEQ ID NO: 8958 - RNA, 17 nt, Artificial Sequence
  Synthetic
ggagccagcagaccugc

SEQ ID NO: 8959 - RNA, 17 nt, Artificial Sequence
  Synthetic
gcugggccuuugucugc

SEQ ID NO: 8960 - RNA, 17 nt, Artificial Sequence
  Synthetic
guuggggccaaaagugc

SEQ ID NO: 8961 - RNA, 17 nt, Artificial Sequence
  Synthetic
gcaggcacugaaggugc

SEQ ID NO: 8962 - RNA, 17 nt, Artificial Sequence
  Synthetic
gucugcucucugggugc

SEQ ID NO: 8963 - RNA, 17 nt, Artificial Sequence
  Synthetic
gcugagcaccuuauugc

SEQ ID NO: 8964 - RNA, 17 nt, Artificial Sequence
  Synthetic
ggggcagagacagaauc

SEQ ID NO: 8965 - RNA, 17 nt, Artificial Sequence
  Synthetic
gugggagcagcgcacuc

SEQ ID NO: 8966 - RNA, 17 nt, Artificial Sequence
  Synthetic
ggcccucgcgcugccuc

SEQ ID NO: 8967 - RNA, 17 nt, Artificial Sequence
  Synthetic
ggcaguacuccaggcuc

SEQ ID NO: 8968 - RNA, 17 nt, Artificial Sequence
  Synthetic
gguguguaucaaugcuc

SEQ ID NO: 8969 - RNA, 17 nt, Artificial Sequence
  Synthetic
gaguuucuaggggucuc

SEQ ID NO: 8970 - RNA, 17 nt, Artificial Sequence
  Synthetic
ggacacagcucgagguc

SEQ ID NO: 8971 - RNA, 17 nt, Artificial Sequence
  Synthetic
gcuagugguuggauuuc

SEQ ID NO: 8972 - RNA, 17 nt, Artificial Sequence
  Synthetic
gcuagaggcucagcaag

SEQ ID NO: 8973 - RNA, 17 nt, Artificial Sequence
  Synthetic
ggaaugugggcaaccag

SEQ ID NO: 8974 - RNA, 17 nt, Artificial Sequence
  Synthetic
gggcuaggggagccuag

SEQ ID NO: 8975 - RNA, 17 nt, Artificial Sequence
  Synthetic
gugcuuccaggagcuag

SEQ ID NO: 8976 - RNA, 17 nt, Artificial Sequence
  Synthetic
gagacuggaguuucuag

SEQ ID NO: 8977 - RNA, 17 nt, Artificial Sequence
  Synthetic
gggcacugagugaguag

SEQ ID NO: 8978 - RNA, 17 nt, Artificial Sequence
  Synthetic
guccacaguguccugcg

SEQ ID NO: 8979 - RNA, 17 nt, Artificial Sequence
  Synthetic
ggacaaaacucgaaagg

SEQ ID NO: 8980 - RNA, 17 nt, Artificial Sequence
  Synthetic
gacgcagacaggcaagg

SEQ ID NO: 8981 - RNA, 17 nt, Artificial Sequence
  Synthetic
ggaaccgggaggacagg

SEQ ID NO: 8982 - RNA, 17 nt, Artificial Sequence
  Synthetic
ggagcagcgcacucagg

SEQ ID NO: 8983 - RNA, 17 nt, Artificial Sequence
  Synthetic
guagauagccccagagg

SEQ ID NO: 8984 - RNA, 17 nt, Artificial Sequence
  Synthetic
gggccuagagugagagg

SEQ ID NO: 8985 - RNA, 17 nt, Artificial Sequence
  Synthetic
gcauugauacacaccgg

SEQ ID NO: 8986 - RNA, 17 nt, Artificial Sequence
  Synthetic
gcacugaaggugcaggg

SEQ ID NO: 8987 - RNA, 17 nt, Artificial Sequence
  Synthetic
gacccaaaaagggcugg

SEQ ID NO: 8988 - RNA, 17 nt, Artificial Sequence
  Synthetic
ggucuggacaagguugg

SEQ ID NO: 8989 - RNA, 17 nt, Artificial Sequence
  Synthetic
ggggucucugggauaug

SEQ ID NO: 8990 - RNA, 17 nt, Artificial Sequence
  Synthetic
ggccacgcaggacacug

SEQ ID NO: 8991 - RNA, 17 nt, Artificial Sequence
  Synthetic
gugcagcggccuggcug

SEQ ID NO: 8992 - RNA, 17 nt, Artificial Sequence
  Synthetic
ggguccaaccuggucug

SEQ ID NO: 8993 - RNA, 17 nt, Artificial Sequence
  Synthetic
gauaaaucaguuuucug

SEQ ID NO: 8994 - RNA, 17 nt, Artificial Sequence
  Synthetic
gugaguagaggcaggug

SEQ ID NO: 8995 - RNA, 17 nt, Artificial Sequence
  Synthetic
gcugcaccugucaggug

SEQ ID NO: 8996 - RNA, 17 nt, Artificial Sequence
  Synthetic
ggucucugggauaugug

SEQ ID NO: 8997 - RNA, 17 nt, Artificial Sequence
  Synthetic
gagccagguccuuacau

SEQ ID NO: 8998 - RNA, 17 nt, Artificial Sequence
  Synthetic
gcgaaggacagagagau

SEQ ID NO: 8999 - RNA, 17 nt, Artificial Sequence
  Synthetic
gggcuaggcggggcccu

SEQ ID NO: 9000 - RNA, 17 nt, Artificial Sequence
  Synthetic
gaaaacugauuuauccu

SEQ ID NO: 9001 - RNA, 17 nt, Artificial Sequence
  Synthetic
gugcuggguuaucuccu

SEQ ID NO: 9002 - RNA, 17 nt, Artificial Sequence
  Synthetic
guaucaaugcucaggcu

SEQ ID NO: 9003 - RNA, 17 nt, Artificial Sequence
  Synthetic
ggugcagcggccuggcu

SEQ ID NO: 9004 - RNA, 17 nt, Artificial Sequence
  Synthetic
ggauucgucugcucucu

SEQ ID NO: 9005 - RNA, 17 nt, Artificial Sequence
  Synthetic
gagaugacaccuucucu

SEQ ID NO: 9006 - RNA, 17 nt, Artificial Sequence
  Synthetic
gggagacuggaguuucu

SEQ ID NO: 9007 - RNA, 17 nt, Artificial Sequence
  Synthetic
gggauauguggggcagu

SEQ ID NO: 9008 - RNA, 17 nt, Artificial Sequence
  Synthetic
gagcagcgcacucaggu

SEQ ID NO: 9009 - RNA, 17 nt, Artificial Sequence
  Synthetic
gggucucugggauaugu

SEQ ID NO: 9010 - RNA, 17 nt, Artificial Sequence
  Synthetic
guucuuuuuuacacugu

SEQ ID NO: 9011 - RNA, 17 nt, Artificial Sequence
  Synthetic
gggugaggcugaccugu

SEQ ID NO: 9012 - RNA, 17 nt, Artificial Sequence
  Synthetic
guugcccuccuagcugu

SEQ ID NO: 9013 - RNA, 17 nt, Artificial Sequence
  Synthetic
gggucaguuucuucauu

SEQ ID NO: 9014 - RNA, 17 nt, Artificial Sequence
  Synthetic
gggagcccuccuuccuu

SEQ ID NO: 9015 - RNA, 17 nt, Artificial Sequence
  Synthetic
gcagaccugcgggaguu

SEQ ID NO: 9016 - RNA, 20 nt, Artificial Sequence
  Synthetic
gcaagugggcagcccuccaa

SEQ ID NO: 9017 - RNA, 20 nt, Artificial Sequence
  Synthetic
gucuccaggaaggagagcaa

SEQ ID NO: 9018 - RNA, 20 nt, Artificial Sequence
  Synthetic
gcaaauaguuuucauaucaa

SEQ ID NO: 9019 - RNA, 20 nt, Artificial Sequence
  Synthetic
ggagggcaacacaaggagaa

SEQ ID NO: 9020 - RNA, 20 nt, Artificial Sequence
  Synthetic
ggagcugggcuucccuagaa

SEQ ID NO: 9021 - RNA, 20 nt, Artificial Sequence
  Synthetic
gugcuaggacaaaacucgaa

SEQ ID NO: 9022 - RNA, 20 nt, Artificial Sequence
  Synthetic
gcugccagauucaacuggaa

SEQ ID NO: 9023 - RNA, 20 nt, Artificial Sequence
  Synthetic
ggauguggccagcgcuggaa

SEQ ID NO: 9024 - RNA, 20 nt, Artificial Sequence
  Synthetic
gccccucccgggucuggaca

SEQ ID NO: 9025 - RNA, 20 nt, Artificial Sequence
  Synthetic
gaagaaacugacccuuccca

SEQ ID NO: 9026 - RNA, 20 nt, Artificial Sequence
  Synthetic
gagauaagacauaagagcca

SEQ ID NO: 9027 - RNA, 20 nt, Artificial Sequence
  Synthetic
gcccgcccgcuggccggcca

SEQ ID NO: 9028 - RNA, 20 nt, Artificial Sequence
  Synthetic
ggagugccaaguggugagca

SEQ ID NO: 9029 - RNA, 20 nt, Artificial Sequence
  Synthetic
gcuggcaaauagaaaaggca

SEQ ID NO: 9030 - RNA, 20 nt, Artificial Sequence
  Synthetic
gcuuuagacgcagacaggca

SEQ ID NO: 9031 - RNA, 20 nt, Artificial Sequence
  Synthetic
gccuagagugagagggggca

SEQ ID NO: 9032 - RNA, 20 nt, Artificial Sequence
  Synthetic
gagaaggcggacucugggca

SEQ ID NO: 9033 - RNA, 20 nt, Artificial Sequence
  Synthetic
gugcugagcaccuuauugca

SEQ ID NO: 9034 - RNA, 20 nt, Artificial Sequence
  Synthetic
ggcaaauaguuuucauauca

SEQ ID NO: 9035 - RNA, 20 nt, Artificial Sequence
  Synthetic
ggaaggcugccgcuuccuca

SEQ ID NO: 9036 - RNA, 20 nt, Artificial Sequence
  Synthetic
gccagcgcuggaaaggaaga

SEQ ID NO: 9037 - RNA, 20 nt, Artificial Sequence
  Synthetic
gcugagggccuagagugaga

SEQ ID NO: 9038 - RNA, 20 nt, Artificial Sequence
  Synthetic
ggcaaccagaggcagcgcga

SEQ ID NO: 9039 - RNA, 20 nt, Artificial Sequence
  Synthetic
gccgggaguuuuccgaagga

SEQ ID NO: 9040 - RNA, 20 nt, Artificial Sequence
  Synthetic
ggaguuuuccgaaggaagga

SEQ ID NO: 9041 - RNA, 20 nt, Artificial Sequence
  Synthetic
gcccgcuggccggccaggga

SEQ ID NO: 9042 - RNA, 20 nt, Artificial Sequence
  Synthetic
ggcccugcacgcggcaggga

SEQ ID NO: 9043 - RNA, 20 nt, Artificial Sequence
  Synthetic
gaccugugggugcccuugga

SEQ ID NO: 9044 - RNA, 20 nt, Artificial Sequence
  Synthetic
gaggaggagaaauucguuga

SEQ ID NO: 9045 - RNA, 20 nt, Artificial Sequence
  Synthetic
gcaugguccucccugcaaua

SEQ ID NO: 9046 - RNA, 20 nt, Artificial Sequence
  Synthetic
gccugcaauacaauaagaua

SEQ ID NO: 9047 - RNA, 20 nt, Artificial Sequence
  Synthetic
gacauaagagccaagggcua

SEQ ID NO: 9048 - RNA, 20 nt, Artificial Sequence
  Synthetic
gcagaggagaggccguucua

SEQ ID NO: 9049 - RNA, 20 nt, Artificial Sequence
  Synthetic
ggaggaccaugcccaaugua

SEQ ID NO: 9050 - RNA, 20 nt, Artificial Sequence
  Synthetic
gaaauccaaccacuagcuua

SEQ ID NO: 9051 - RNA, 20 nt, Artificial Sequence
  Synthetic
guuuggcugccagauucaac

SEQ ID NO: 9052 - RNA, 20 nt, Artificial Sequence
  Synthetic
gcucccgagggcaggugaac

SEQ ID NO: 9053 - RNA, 20 nt, Artificial Sequence
  Synthetic
gccugagcauugauacacac

SEQ ID NO: 9054 - RNA, 20 nt, Artificial Sequence
  Synthetic
gaaggcugccgcuuccucac

SEQ ID NO: 9055 - RNA, 20 nt, Artificial Sequence
  Synthetic
gagugcaggaauguggucac

SEQ ID NO: 9056 - RNA, 20 nt, Artificial Sequence
  Synthetic
ggaccuggcucaagggagac

SEQ ID NO: 9057 - RNA, 20 nt, Artificial Sequence
  Synthetic
ggcauggcacacgccuagac

SEQ ID NO: 9058 - RNA, 20 nt, Artificial Sequence
  Synthetic
ggguggggaaccgggaggac

SEQ ID NO: 9059 - RNA, 20 nt, Artificial Sequence
  Synthetic
gguugcggcuggacugggac

SEQ ID NO: 9060 - RNA, 20 nt, Artificial Sequence
  Synthetic
ggcaggugaacugggaguac

SEQ ID NO: 9061 - RNA, 20 nt, Artificial Sequence
  Synthetic
gucaaccaggauuccaaacc

SEQ ID NO: 9062 - RNA, 20 nt, Artificial Sequence
  Synthetic
gucccaguccagccgcaacc

SEQ ID NO: 9063 - RNA, 20 nt, Artificial Sequence
  Synthetic
gagggccuggguggggaacc

SEQ ID NO: 9064 - RNA, 20 nt, Artificial Sequence
  Synthetic
gaucggggcucaggugcacc

SEQ ID NO: 9065 - RNA, 20 nt, Artificial Sequence
  Synthetic
gccuagcccccagcuucacc

SEQ ID NO: 9066 - RNA, 20 nt, Artificial Sequence
  Synthetic
ggacacuguggacacagacc

SEQ ID NO: 9067 - RNA, 20 nt, Artificial Sequence
  Synthetic
guccucccgguuccccaccc

SEQ ID NO: 9068 - RNA, 20 nt, Artificial Sequence
  Synthetic
gcacacgccuagacaggccc

SEQ ID NO: 9069 - RNA, 20 nt, Artificial Sequence
  Synthetic
gcuucaccugggccccuccc

SEQ ID NO: 9070 - RNA, 20 nt, Artificial Sequence
  Synthetic
gcugaggaggagucagagcc

SEQ ID NO: 9071 - RNA, 20 nt, Artificial Sequence
  Synthetic
gcgauuacacauuccuggcc

SEQ ID NO: 9072 - RNA, 20 nt, Artificial Sequence
  Synthetic
gugagaagaauugcaaugcc

SEQ ID NO: 9073 - RNA, 20 nt, Artificial Sequence
  Synthetic
gggaaccugguuuggaaucc

SEQ ID NO: 9074 - RNA, 20 nt, Artificial Sequence
  Synthetic
gggaugcgucugccuccucc

SEQ ID NO: 9075 - RNA, 20 nt, Artificial Sequence
  Synthetic
ggagucccaagugugcuucc

SEQ ID NO: 9076 - RNA, 20 nt, Artificial Sequence
  Synthetic
gugcaccuggaugugaaagc

SEQ ID NO: 9077 - RNA, 20 nt, Artificial Sequence
  Synthetic
gcaaccugggagugggaagc

SEQ ID NO: 9078 - RNA, 20 nt, Artificial Sequence
  Synthetic
ggggguggcgaggaaucagc

SEQ ID NO: 9079 - RNA, 20 nt, Artificial Sequence
  Synthetic
gcugcucccacuuagugagc

SEQ ID NO: 9080 - RNA, 20 nt, Artificial Sequence
  Synthetic
guguguaucaaugcucaggc

SEQ ID NO: 9081 - RNA, 20 nt, Artificial Sequence
  Synthetic
gaaucagacccaaaaagggc

SEQ ID NO: 9082 - RNA, 20 nt, Artificial Sequence
  Synthetic
gaaggagggcucccgagggc

SEQ ID NO: 9083 - RNA, 20 nt, Artificial Sequence
  Synthetic
gacaggugcagcggccuggc

SEQ ID NO: 9084 - RNA, 20 nt, Artificial Sequence
  Synthetic
ggagccuaggggcucacugc

SEQ ID NO: 9085 - RNA, 20 nt, Artificial Sequence
  Synthetic
ggaguuggggccaaaagugc

SEQ ID NO: 9086 - RNA, 20 nt, Artificial Sequence
  Synthetic
ggugcugagcaccuuauugc

SEQ ID NO: 9087 - RNA, 20 nt, Artificial Sequence
  Synthetic
gguuccuuuccaguugaauc

SEQ ID NO: 9088 - RNA, 20 nt, Artificial Sequence
  Synthetic
gggcucacugcaggagacuc

SEQ ID NO: 9089 - RNA, 20 nt, Artificial Sequence
  Synthetic
ggaccugagaaggcggacuc

SEQ ID NO: 9090 - RNA, 20 nt, Artificial Sequence
  Synthetic
guucuagggaagcccagcuc

SEQ ID NO: 9091 - RNA, 20 nt, Artificial Sequence
  Synthetic
gcccuccuagcugugggcuc

SEQ ID NO: 9092 - RNA, 20 nt, Artificial Sequence
  Synthetic
gccaggccgcugcaccuguc

SEQ ID NO: 9093 - RNA, 20 nt, Artificial Sequence
  Synthetic
gcgaggaaucagcaggaaag

SEQ ID NO: 9094 - RNA, 20 nt, Artificial Sequence
  Synthetic
ggagcuagaggcucagcaag

SEQ ID NO: 9095 - RNA, 20 nt, Artificial Sequence
  Synthetic
gugagagggggcaaggcaag

SEQ ID NO: 9096 - RNA, 20 nt, Artificial Sequence
  Synthetic
ggccagcgcuggaaaggaag

SEQ ID NO: 9097 - RNA, 20 nt, Artificial Sequence
  Synthetic
gcaggaaugugggcaaccag

SEQ ID NO: 9098 - RNA, 20 nt, Artificial Sequence
  Synthetic
gcaagagacugccgcaagag

SEQ ID NO: 9099 - RNA, 20 nt, Artificial Sequence
  Synthetic
gaaacagaaggcagauagag

SEQ ID NO: 9100 - RNA, 20 nt, Artificial Sequence
  Synthetic
guccagccgcaaccugggag

SEQ ID NO: 9101 - RNA, 20 nt, Artificial Sequence
  Synthetic
gggucuggacaagguuggag

SEQ ID NO: 9102 - RNA, 20 nt, Artificial Sequence
  Synthetic
gccaugcugccuuaagcuag

SEQ ID NO: 9103 - RNA, 20 nt, Artificial Sequence
  Synthetic
gaggggcacugagugaguag

SEQ ID NO: 9104 - RNA, 20 nt, Artificial Sequence
  Synthetic
gggcaaccagaggcagcgcg

SEQ ID NO: 9105 - RNA, 20 nt, Artificial Sequence
  Synthetic
gugaagcugggggcuaggcg

SEQ ID NO: 9106 - RNA, 20 nt, Artificial Sequence
  Synthetic
gacagacucaugggggaucg

SEQ ID NO: 9107 - RNA, 20 nt, Artificial Sequence
  Synthetic
gaguacuggaccugagaagg

SEQ ID NO: 9108 - RNA, 20 nt, Artificial Sequence
  Synthetic
gggaguuuuccgaaggaagg

SEQ ID NO: 9109 - RNA, 20 nt, Artificial Sequence
  Synthetic
gugggagcagcgcacucagg

SEQ ID NO: 9110 - RNA, 20 nt, Artificial Sequence
  Synthetic
guagauagccccagaggagg

SEQ ID NO: 9111 - RNA, 20 nt, Artificial Sequence
  Synthetic
ggucuggacaagguuggagg

SEQ ID NO: 9112 - RNA, 20 nt, Artificial Sequence
  Synthetic
ggcaaauagaaaaggcaggg

SEQ ID NO: 9113 - RNA, 20 nt, Artificial Sequence
  Synthetic
ggccuggguggggaaccggg

SEQ ID NO: 9114 - RNA, 20 nt, Artificial Sequence
  Synthetic
gcauugauacacaccggggg

SEQ ID NO: 9115 - RNA, 20 nt, Artificial Sequence
  Synthetic
gcuggcuccaggaaaggugg

SEQ ID NO: 9116 - RNA, 20 nt, Artificial Sequence
  Synthetic
gucacagaguugcaggaaug

SEQ ID NO: 9117 - RNA, 20 nt, Artificial Sequence
  Synthetic
gagggccacgcaggacacug

SEQ ID NO: 9118 - RNA, 20 nt, Artificial Sequence
  Synthetic
gcacucugggcugccuccug

SEQ ID NO: 9119 - RNA, 20 nt, Artificial Sequence
  Synthetic
gccgcugcaccugucaggug

SEQ ID NO: 9120 - RNA, 20 nt, Artificial Sequence
  Synthetic
ggccuuugucugcuggcuug

SEQ ID NO: 9121 - RNA, 20 nt, Artificial Sequence
  Synthetic
gagacagacucaugggggau

SEQ ID NO: 9122 - RNA, 20 nt, Artificial Sequence
  Synthetic
gucuccugcagugagccccu

SEQ ID NO: 9123 - RNA, 20 nt, Artificial Sequence
  Synthetic
ggcugaccugugggugcccu

SEQ ID NO: 9124 - RNA, 20 nt, Artificial Sequence
  Synthetic
gccaagggcuaggggagccu

SEQ ID NO: 9125 - RNA, 20 nt, Artificial Sequence
  Synthetic
gccuugcccccucucacucu

SEQ ID NO: 9126 - RNA, 20 nt, Artificial Sequence
  Synthetic
gaccugagaaggcggacucu

SEQ ID NO: 9127 - RNA, 20 nt, Artificial Sequence
  Synthetic
gccagcagaccugcgggagu

SEQ ID NO: 9128 - RNA, 20 nt, Artificial Sequence
  Synthetic
gaggaagccacagaccaggu

SEQ ID NO: 9129 - RNA, 20 nt, Artificial Sequence
  Synthetic
gcgcuggaaaggaagagggu

SEQ ID NO: 9130 - RNA, 20 nt, Artificial Sequence
  Synthetic
gugcagggccuggguugugu

SEQ ID NO: 9131 - RNA, 20 nt, Artificial Sequence
  Synthetic
gaagggucaguuucuucauu

SEQ ID NO: 9132 - RNA, 20 nt, Artificial Sequence
  Synthetic
gagucuccuccagcccuuuu

SEQ ID NO: 9133 - RNA, 17 nt, Artificial Sequence
  Synthetic
aaggagccagcaccaaa

SEQ ID NO: 9134 - RNA, 17 nt, Artificial Sequence
  Synthetic
aaacuuaaugcagcaaa

SEQ ID NO: 9135 - RNA, 17 nt, Artificial Sequence
  Synthetic
cugucucaggaaguaaa

SEQ ID NO: 9136 - RNA, 17 nt, Artificial Sequence
  Synthetic
uaagacauaagagccaa

SEQ ID NO: 9137 - RNA, 17 nt, Artificial Sequence
  Synthetic
agugggcagcccuccaa

SEQ ID NO: 9138 - RNA, 17 nt, Artificial Sequence
  Synthetic
uggcuguuugaucucaa

SEQ ID NO: 9139 - RNA, 17 nt, Artificial Sequence
  Synthetic
cuaggacaaaacucgaa

SEQ ID NO: 9140 - RNA, 17 nt, Artificial Sequence
  Synthetic
ucugcuggcuccaggaa

SEQ ID NO: 9141 - RNA, 17 nt, Artificial Sequence
  Synthetic
ugauuuauccuugggaa

SEQ ID NO: 9142 - RNA, 17 nt, Artificial Sequence
  Synthetic
uguggccagcgcuggaa

SEQ ID NO: 9143 - RNA, 17 nt, Artificial Sequence
  Synthetic
auuagcaucucaauuaa

SEQ ID NO: 9144 - RNA, 17 nt, Artificial Sequence
  Synthetic
ccucccgggucuggaca

SEQ ID NO: 9145 - RNA, 17 nt, Artificial Sequence
  Synthetic
uugagaucaaacagcca

SEQ ID NO: 9146 - RNA, 17 nt, Artificial Sequence
  Synthetic
auaagacauaagagcca

SEQ ID NO: 9147 - RNA, 17 nt, Artificial Sequence
  Synthetic
accuuuucacagagcca

SEQ ID NO: 9148 - RNA, 17 nt, Artificial Sequence
  Synthetic
cgcccgcuggccggcca

SEQ ID NO: 9149 - RNA, 17 nt, Artificial Sequence
  Synthetic
aagugggcagcccucca

SEQ ID NO: 9150 - RNA, 17 nt, Artificial Sequence
  Synthetic
cugaaucuugacaagca

SEQ ID NO: 9151 - RNA, 17 nt, Artificial Sequence
  Synthetic
acucugugaccacagca

SEQ ID NO: 9152 - RNA, 17 nt, Artificial Sequence
  Synthetic
acuagcuuaaggcagca

SEQ ID NO: 9153 - RNA, 17 nt, Artificial Sequence
  Synthetic
ucaauuaaaggugagca

SEQ ID NO: 9154 - RNA, 17 nt, Artificial Sequence
  Synthetic
ugagagggggcaaggca

SEQ ID NO: 9155 - RNA, 17 nt, Artificial Sequence
  Synthetic
uuagacgcagacaggca

SEQ ID NO: 9156 - RNA, 17 nt, Artificial Sequence
  Synthetic
aggcccugcacgcggca

SEQ ID NO: 9157 - RNA, 17 nt, Artificial Sequence
  Synthetic
cuucccugccgcgugca

SEQ ID NO: 9158 - RNA, 17 nt, Artificial Sequence
  Synthetic
caggcacugaaggugca

SEQ ID NO: 9159 - RNA, 17 nt, Artificial Sequence
  Synthetic
cugagcaccuuauugca

SEQ ID NO: 9160 - RNA, 17 nt, Artificial Sequence
  Synthetic
uuccugagacagacuca

SEQ ID NO: 9161 - RNA, 17 nt, Artificial Sequence
  Synthetic
aggcugccgcuuccuca

SEQ ID NO: 9162 - RNA, 17 nt, Artificial Sequence
  Synthetic
uguaaggaccuggcuca

SEQ ID NO: 9163 - RNA, 17 nt, Artificial Sequence
  Synthetic
agcgcuggaaaggaaga

SEQ ID NO: 9164 - RNA, 17 nt, Artificial Sequence
  Synthetic
agggcaacacaaggaga

SEQ ID NO: 9165 - RNA, 17 nt, Artificial Sequence
  Synthetic
uggugggggcaaauaga

SEQ ID NO: 9166 - RNA, 17 nt, Artificial Sequence
  Synthetic
agccgggaguuuuccga

SEQ ID NO: 9167 - RNA, 17 nt, Artificial Sequence
  Synthetic
aaccagaggcagcgcga

SEQ ID NO: 9168 - RNA, 17 nt, Artificial Sequence
  Synthetic
ugagcccacagcuagga

SEQ ID NO: 9169 - RNA, 17 nt, Artificial Sequence
  Synthetic
cgcuggccggccaggga

SEQ ID NO: 9170 - RNA, 17 nt, Artificial Sequence
  Synthetic
ccugcacgcggcaggga

SEQ ID NO: 9171 - RNA, 17 nt, Artificial Sequence
  Synthetic
cuuguccagacccggga

SEQ ID NO: 9172 - RNA, 17 nt, Artificial Sequence
  Synthetic
ugagcagggcgggggga

SEQ ID NO: 9173 - RNA, 17 nt, Artificial Sequence
  Synthetic
ugacaccuucucuggga

SEQ ID NO: 9174 - RNA, 17 nt, Artificial Sequence
  Synthetic
cugugggugcccuugga

SEQ ID NO: 9175 - RNA, 17 nt, Artificial Sequence
  Synthetic
cugcaccugucagguga

SEQ ID NO: 9176 - RNA, 17 nt, Artificial Sequence
  Synthetic
ugguccucccugcaaua

SEQ ID NO: 9177 - RNA, 17 nt, Artificial Sequence
  Synthetic
cgaaggacagagagaua

SEQ ID NO: 9178 - RNA, 17 nt, Artificial Sequence
  Synthetic
agggcuaggggagccua

SEQ ID NO: 9179 - RNA, 17 nt, Artificial Sequence
  Synthetic
aagaacagaauguccua

SEQ ID NO: 9180 - RNA, 17 nt, Artificial Sequence
  Synthetic
auaagagccaagggcua

SEQ ID NO: 9181 - RNA, 17 nt, Artificial Sequence
  Synthetic
auccaaccacuagcuua

SEQ ID NO: 9182 - RNA, 17 nt, Artificial Sequence
  Synthetic
uggcugccagauucaac

SEQ ID NO: 9183 - RNA, 17 nt, Artificial Sequence
  Synthetic
cccgagggcaggugaac

SEQ ID NO: 9184 - RNA, 17 nt, Artificial Sequence
  Synthetic
ugagcauugauacacac

SEQ ID NO: 9185 - RNA, 17 nt, Artificial Sequence
  Synthetic
ccuccaagggcacccac

SEQ ID NO: 9186 - RNA, 17 nt, Artificial Sequence
  Synthetic
uuccucacgggccccac

SEQ ID NO: 9187 - RNA, 17 nt, Artificial Sequence
  Synthetic
agagcagacgaauccac

SEQ ID NO: 9188 - RNA, 17 nt, Artificial Sequence
  Synthetic
ugcaggaauguggucac

SEQ ID NO: 9189 - RNA, 17 nt, Artificial Sequence
  Synthetic
ccuggcucaagggagac

SEQ ID NO: 9190 - RNA, 17 nt, Artificial Sequence
  Synthetic
auggcacacgccuagac

SEQ ID NO: 9191 - RNA, 17 nt, Artificial Sequence
  Synthetic
ccagggauggaagcgac

SEQ ID NO: 9192 - RNA, 17 nt, Artificial Sequence
  Synthetic
uggggaaccgggaggac

SEQ ID NO: 9193 - RNA, 17 nt, Artificial Sequence
  Synthetic
ugcggcuggacugggac

SEQ ID NO: 9194 - RNA, 17 nt, Artificial Sequence
  Synthetic
ccagguugcggcuggac

SEQ ID NO: 9195 - RNA, 17 nt, Artificial Sequence
  Synthetic
ccucccccucaccugac

SEQ ID NO: 9196 - RNA, 17 nt, Artificial Sequence
  Synthetic
aggugaacugggaguac

SEQ ID NO: 9197 - RNA, 17 nt, Artificial Sequence
  Synthetic
aggcucaggguccaacc

SEQ ID NO: 9198 - RNA, 17 nt, Artificial Sequence
  Synthetic
ccaguccagccgcaacc

SEQ ID NO: 9199 - RNA, 17 nt, Artificial Sequence
  Synthetic
ccaaccuuguccagacc

SEQ ID NO: 9200 - RNA, 17 nt, Artificial Sequence
  Synthetic
ugcccaauguaaggacc

SEQ ID NO: 9201 - RNA, 17 nt, Artificial Sequence
  Synthetic
cucccgguuccccaccc

SEQ ID NO: 9202 - RNA, 17 nt, Artificial Sequence
  Synthetic
uaaggugcucagcaccc

SEQ ID NO: 9203 - RNA, 17 nt, Artificial Sequence
  Synthetic
caaccuuguccagaccc

SEQ ID NO: 9204 - RNA, 17 nt, Artificial Sequence
  Synthetic
aggccuaucuccucccc

SEQ ID NO: 9205 - RNA, 17 nt, Artificial Sequence
  Synthetic
acacagacccggagccc

SEQ ID NO: 9206 - RNA, 17 nt, Artificial Sequence
  Synthetic
agacccgggaggggccc

SEQ ID NO: 9207 - RNA, 17 nt, Artificial Sequence
  Synthetic
ccugucgcuuccauccc

SEQ ID NO: 9208 - RNA, 17 nt, Artificial Sequence
  Synthetic
agguuggacccugagcc

SEQ ID NO: 9209 - RNA, 17 nt, Artificial Sequence
  Synthetic
ccagucucccuugagcc

SEQ ID NO: 9210 - RNA, 17 nt, Artificial Sequence
  Synthetic
ccgcccgcuggccggcc

SEQ ID NO: 9211 - RNA, 17 nt, Artificial Sequence
  Synthetic
ugacaggugcagcggcc

SEQ ID NO: 9212 - RNA, 17 nt, Artificial Sequence
  Synthetic
cugccgcgugcagggcc

SEQ ID NO: 9213 - RNA, 17 nt, Artificial Sequence
  Synthetic
agaagaauugcaaugcc

SEQ ID NO: 9214 - RNA, 17 nt, Artificial Sequence
  Synthetic
uuacacuguuggcugcc

SEQ ID NO: 9215 - RNA, 17 nt, Artificial Sequence
  Synthetic
ucccggcuuucacaucc

SEQ ID NO: 9216 - RNA, 17 nt, Artificial Sequence
  Synthetic
agcugagacacagaucc

SEQ ID NO: 9217 - RNA, 17 nt, Artificial Sequence
  Synthetic
uuccuucggaaaacucc

SEQ ID NO: 9218 - RNA, 17 nt, Artificial Sequence
  Synthetic
agaaaaggcaguacucc

SEQ ID NO: 9219 - RNA, 17 nt, Artificial Sequence
  Synthetic
uucaccugggccccucc

SEQ ID NO: 9220 - RNA, 17 nt, Artificial Sequence
  Synthetic
augcgucugccuccucc

SEQ ID NO: 9221 - RNA, 17 nt, Artificial Sequence
  Synthetic
uuuggucuucuuccucc

SEQ ID NO: 9222 - RNA, 17 nt, Artificial Sequence
  Synthetic
aaagggagucugucucc

SEQ ID NO: 9223 - RNA, 17 nt, Artificial Sequence
  Synthetic
cuucuuaaagugaaagc

SEQ ID NO: 9224 - RNA, 17 nt, Artificial Sequence
  Synthetic
caccuggaugugaaagc

SEQ ID NO: 9225 - RNA, 17 nt, Artificial Sequence
  Synthetic
aggggcccaggugaagc

SEQ ID NO: 9226 - RNA, 17 nt, Artificial Sequence
  Synthetic
aacucugugaccacagc

SEQ ID NO: 9227 - RNA, 17 nt, Artificial Sequence
  Synthetic
aucccuggccggccagc

SEQ ID NO: 9228 - RNA, 17 nt, Artificial Sequence
  Synthetic
cucaauuaaaggugagc

SEQ ID NO: 9229 - RNA, 17 nt, Artificial Sequence
  Synthetic
caagcaaggaguuuagc

SEQ ID NO: 9230 - RNA, 17 nt, Artificial Sequence
  Synthetic
cagcgcgagggccacgc

SEQ ID NO: 9231 - RNA, 17 nt, Artificial Sequence
  Synthetic
cuggggagcccgcccgc

SEQ ID NO: 9232 - RNA, 17 nt, Artificial Sequence
  Synthetic
uuggccccaacucccgc

SEQ ID NO: 9233 - RNA, 17 nt, Artificial Sequence
  Synthetic
cucuuccuuuccagcgc

SEQ ID NO: 9234 - RNA, 17 nt, Artificial Sequence
  Synthetic
uggcaaauagaaaaggc

SEQ ID NO: 9235 - RNA, 17 nt, Artificial Sequence
  Synthetic
uguaucaaugcucaggc

SEQ ID NO: 9236 - RNA, 17 nt, Artificial Sequence
  Synthetic
acugagugaguagaggc

SEQ ID NO: 9237 - RNA, 17 nt, Artificial Sequence
  Synthetic
caggcccugcacgcggc

SEQ ID NO: 9238 - RNA, 17 nt, Artificial Sequence
  Synthetic
cacucccagguugcggc

SEQ ID NO: 9239 - RNA, 17 nt, Artificial Sequence
  Synthetic
ucagacccaaaaagggc

SEQ ID NO: 9240 - RNA, 17 nt, Artificial Sequence
  Synthetic
uuaaaggugagcagggc

SEQ ID NO: 9241 - RNA, 17 nt, Artificial Sequence
  Synthetic
cuggccggccagcgggc

SEQ ID NO: 9242 - RNA, 17 nt, Artificial Sequence
  Synthetic
ucgcuuccaucccuggc

SEQ ID NO: 9243 - RNA, 17 nt, Artificial Sequence
  Synthetic
aggugcagcggccuggc

SEQ ID NO: 9244 - RNA, 17 nt, Artificial Sequence
  Synthetic
agagaagaggucucugc

SEQ ID NO: 9245 - RNA, 17 nt, Artificial Sequence
  Synthetic
aacucccgcaggucugc

SEQ ID NO: 9246 - RNA, 17 nt, Artificial Sequence
  Synthetic
ccuucccugccgcgugc

SEQ ID NO: 9247 - RNA, 17 nt, Artificial Sequence
  Synthetic
cagacucccuuuggugc

SEQ ID NO: 9248 - RNA, 17 nt, Artificial Sequence
  Synthetic
uuaucuuauuguauugc

SEQ ID NO: 9249 - RNA, 17 nt, Artificial Sequence
  Synthetic
uguggucacagaguugc

SEQ ID NO: 9250 - RNA, 17 nt, Artificial Sequence
  Synthetic
uccuuuccaguugaauc

SEQ ID NO: 9251 - RNA, 17 nt, Artificial Sequence
  Synthetic
cagacucaugggggauc

SEQ ID NO: 9252 - RNA, 17 nt, Artificial Sequence
  Synthetic
cgaaagguggcccuauc

SEQ ID NO: 9253 - RNA, 17 nt, Artificial Sequence
  Synthetic
cucacugcaggagacuc

SEQ ID NO: 9254 - RNA, 17 nt, Artificial Sequence
  Synthetic
ccugagaaggcggacuc

SEQ ID NO: 9255 - RNA, 17 nt, Artificial Sequence
  Synthetic
aggucagccucacccuc

SEQ ID NO: 9256 - RNA, 17 nt, Artificial Sequence
  Synthetic
ccaguucaccugcccuc

SEQ ID NO: 9257 - RNA, 17 nt, Artificial Sequence
  Synthetic
cuagggaagcccagcuc

SEQ ID NO: 9258 - RNA, 17 nt, Artificial Sequence
  Synthetic
augggggaucggggcuc

SEQ ID NO: 9259 - RNA, 17 nt, Artificial Sequence
  Synthetic
cuccuagcugugggcuc

SEQ ID NO: 9260 - RNA, 17 nt, Artificial Sequence
  Synthetic
uggauucgucugcucuc

SEQ ID NO: 9261 - RNA, 17 nt, Artificial Sequence
  Synthetic
ccccaugagucugucuc

SEQ ID NO: 9262 - RNA, 17 nt, Artificial Sequence
  Synthetic
agagaugacaccuucuc

SEQ ID NO: 9263 - RNA, 17 nt, Artificial Sequence
  Synthetic
ccagaguccgccuucuc

SEQ ID NO: 9264 - RNA, 17 nt, Artificial Sequence
  Synthetic
aauugcaaugccugguc

SEQ ID NO: 9265 - RNA, 17 nt, Artificial Sequence
  Synthetic
aggccgcugcaccuguc

SEQ ID NO: 9266 - RNA, 17 nt, Artificial Sequence
  Synthetic
aggaguggagugccaag

SEQ ID NO: 9267 - RNA, 17 nt, Artificial Sequence
  Synthetic
cagcgcuggaaaggaag

SEQ ID NO: 9268 - RNA, 17 nt, Artificial Sequence
  Synthetic
acccggagcccaggaag

SEQ ID NO: 9269 - RNA, 17 nt, Artificial Sequence
  Synthetic
uggggcccgugaggaag

SEQ ID NO: 9270 - RNA, 17 nt, Artificial Sequence
  Synthetic
ccuccccgcucacuaag

SEQ ID NO: 9271 - RNA, 17 nt, Artificial Sequence
  Synthetic
uaaguagauagccccag

SEQ ID NO: 9272 - RNA, 17 nt, Artificial Sequence
  Synthetic
caucccuggccggccag

SEQ ID NO: 9273 - RNA, 17 nt, Artificial Sequence
  Synthetic
cucgaggucagggccag

SEQ ID NO: 9274 - RNA, 17 nt, Artificial Sequence
  Synthetic
cccuaucagggaagcag

SEQ ID NO: 9275 - RNA, 17 nt, Artificial Sequence
  Synthetic
cucugugaccacagcag

SEQ ID NO: 9276 - RNA, 17 nt, Artificial Sequence
  Synthetic
ugggauauguggggcag

SEQ ID NO: 9277 - RNA, 17 nt, Artificial Sequence
  Synthetic
aggcggacucugggcag

SEQ ID NO: 9278 - RNA, 17 nt, Artificial Sequence
  Synthetic
ucaccugacaggugcag

SEQ ID NO: 9279 - RNA, 17 nt, Artificial Sequence
  Synthetic
agagacugccgcaagag

SEQ ID NO: 9280 - RNA, 17 nt, Artificial Sequence
  Synthetic
agggccuagagugagag

SEQ ID NO: 9281 - RNA, 17 nt, Artificial Sequence
  Synthetic
uuguccagacccgggag

SEQ ID NO: 9282 - RNA, 17 nt, Artificial Sequence
  Synthetic
caaggcaagggggggag

SEQ ID NO: 9283 - RNA, 17 nt, Artificial Sequence
  Synthetic
cagccgcaaccugggag

SEQ ID NO: 9284 - RNA, 17 nt, Artificial Sequence
  Synthetic
ucuggacaagguuggag

SEQ ID NO: 9285 - RNA, 17 nt, Artificial Sequence
  Synthetic
ugagggccuagagugag

SEQ ID NO: 9286 - RNA, 17 nt, Artificial Sequence
  Synthetic
ugcucccacuuagugag

SEQ ID NO: 9287 - RNA, 17 nt, Artificial Sequence
  Synthetic
augcugccuuaagcuag

SEQ ID NO: 9288 - RNA, 17 nt, Artificial Sequence
  Synthetic
uaagagccaagggcuag

SEQ ID NO: 9289 - RNA, 17 nt, Artificial Sequence
  Synthetic
aacccaggcccugcacg

SEQ ID NO: 9290 - RNA, 17 nt, Artificial Sequence
  Synthetic
agcauugauacacaccg

SEQ ID NO: 9291 - RNA, 17 nt, Artificial Sequence
  Synthetic
cucccacacagagcccg

SEQ ID NO: 9292 - RNA, 17 nt, Artificial Sequence
  Synthetic
aggaaggagggcucccg

SEQ ID NO: 9293 - RNA, 17 nt, Artificial Sequence
  Synthetic
cucccacuuagugagcg

SEQ ID NO: 9294 - RNA, 17 nt, Artificial Sequence
  Synthetic
caaccagaggcagcgcg

SEQ ID NO: 9295 - RNA, 17 nt, Artificial Sequence
  Synthetic
uaaaggugagcagggcg

SEQ ID NO: 9296 - RNA, 17 nt, Artificial Sequence
  Synthetic
agacucaugggggaucg

SEQ ID NO: 9297 - RNA, 17 nt, Artificial Sequence
  Synthetic
aaucaggacacagcucg

SEQ ID NO: 9298 - RNA, 17 nt, Artificial Sequence
  Synthetic
aguuuuccgaaggaagg

SEQ ID NO: 9299 - RNA, 17 nt, Artificial Sequence
  Synthetic
cucacgggccccacagg

SEQ ID NO: 9300 - RNA, 17 nt, Artificial Sequence
  Synthetic
aaaggugagcagggcgg

SEQ ID NO: 9301 - RNA, 17 nt, Artificial Sequence
  Synthetic
auuaaaggugagcaggg

SEQ ID NO: 9302 - RNA, 17 nt, Artificial Sequence
  Synthetic
agcaccuuauugcaggg

SEQ ID NO: 9303 - RNA, 17 nt, Artificial Sequence
  Synthetic
cuggguggggaaccggg

SEQ ID NO: 9304 - RNA, 17 nt, Artificial Sequence
  Synthetic
ccuuguccagacccggg

SEQ ID NO: 9305 - RNA, 17 nt, Artificial Sequence
  Synthetic
ccuggccggccagcggg

SEQ ID NO: 9306 - RNA, 17 nt, Artificial Sequence
  Synthetic
aaggugagcagggcggg

SEQ ID NO: 9307 - RNA, 17 nt, Artificial Sequence
  Synthetic
ccacuuagugagcgggg

SEQ ID NO: 9308 - RNA, 17 nt, Artificial Sequence
  Synthetic
uugauacacaccggggg

SEQ ID NO: 9309 - RNA, 17 nt, Artificial Sequence
  Synthetic
ccuagacaggcccuggg

SEQ ID NO: 9310 - RNA, 17 nt, Artificial Sequence
  Synthetic
cugagacagacucaugg

SEQ ID NO: 9311 - RNA, 17 nt, Artificial Sequence
  Synthetic
ugagacacagauccugg

SEQ ID NO: 9312 - RNA, 17 nt, Artificial Sequence
  Synthetic
ugucugcuggcuugugg

SEQ ID NO: 9313 - RNA, 17 nt, Artificial Sequence
  Synthetic
ccugugggugcccuugg

SEQ ID NO: 9314 - RNA, 17 nt, Artificial Sequence
  Synthetic
acagaguugcaggaaug

SEQ ID NO: 9315 - RNA, 17 nt, Artificial Sequence
  Synthetic
ccugagacagacucaug

SEQ ID NO: 9316 - RNA, 17 nt, Artificial Sequence
  Synthetic
uguugcccuccuagcug

SEQ ID NO: 9317 - RNA, 17 nt, Artificial Sequence
  Synthetic
uguaaucgccccugcug

SEQ ID NO: 9318 - RNA, 17 nt, Artificial Sequence
  Synthetic
cuccuguggggcccgug

SEQ ID NO: 9319 - RNA, 17 nt, Artificial Sequence
  Synthetic
aauccacgggcucugug

SEQ ID NO: 9320 - RNA, 17 nt, Artificial Sequence
  Synthetic
uguggcuuccucucuug

SEQ ID NO: 9321 - RNA, 17 nt, Artificial Sequence
  Synthetic
cagaccugcgggaguug

SEQ ID NO: 9322 - RNA, 17 nt, Artificial Sequence
  Synthetic
uccugagacagacucau

SEQ ID NO: 9323 - RNA, 17 nt, Artificial Sequence
  Synthetic
acaccgggggaggagau

SEQ ID NO: 9324 - RNA, 17 nt, Artificial Sequence
  Synthetic
acagacucaugggggau

SEQ ID NO: 9325 - RNA, 17 nt, Artificial Sequence
  Synthetic
uccucugcuucccugau

SEQ ID NO: 9326 - RNA, 17 nt, Artificial Sequence
  Synthetic
aggagaaauucguugau

SEQ ID NO: 9327 - RNA, 17 nt, Artificial Sequence
  Synthetic
ccgagggcaggugaacu

SEQ ID NO: 9328 - RNA, 17 nt, Artificial Sequence
  Synthetic
ucuccuugcucaccacu

SEQ ID NO: 9329 - RNA, 17 nt, Artificial Sequence
  Synthetic
cagguugcggcuggacu

SEQ ID NO: 9330 - RNA, 17 nt, Artificial Sequence
  Synthetic
caguccagccgcaaccu

SEQ ID NO: 9331 - RNA, 17 nt, Artificial Sequence
  Synthetic
agcccccagcuucaccu

SEQ ID NO: 9332 - RNA, 17 nt, Artificial Sequence
  Synthetic
uaggcuccccuagcccu

SEQ ID NO: 9333 - RNA, 17 nt, Artificial Sequence
  Synthetic
acgccuagacaggcccu

SEQ ID NO: 9334 - RNA, 17 nt, Artificial Sequence
  Synthetic
ugaccugugggugcccu

SEQ ID NO: 9335 - RNA, 17 nt, Artificial Sequence
  Synthetic
aagggcuaggggagccu

SEQ ID NO: 9336 - RNA, 17 nt, Artificial Sequence
  Synthetic
ugccgcgugcagggccu

SEQ ID NO: 9337 - RNA, 17 nt, Artificial Sequence
  Synthetic
auccugagcccacagcu

SEQ ID NO: 9338 - RNA, 17 nt, Artificial Sequence
  Synthetic
ccaaaagugccggagcu

SEQ ID NO: 9339 - RNA, 17 nt, Artificial Sequence
  Synthetic
cauaagagccaagggcu

SEQ ID NO: 9340 - RNA, 17 nt, Artificial Sequence
  Synthetic
ccacauuccugcacucu

SEQ ID NO: 9341 - RNA, 17 nt, Artificial Sequence
  Synthetic
uugcccccucucacucu

SEQ ID NO: 9342 - RNA, 17 nt, Artificial Sequence
  Synthetic
cugagaaggcggacucu

SEQ ID NO: 9343 - RNA, 17 nt, Artificial Sequence
  Synthetic
aguuucuaggggucucu

SEQ ID NO: 9344 - RNA, 17 nt, Artificial Sequence
  Synthetic
agggcuccaggaggucu

SEQ ID NO: 9345 - RNA, 17 nt, Artificial Sequence
  Synthetic
agaggagaggccguucu

SEQ ID NO: 9346 - RNA, 17 nt, Artificial Sequence
  Synthetic
cuagaggcucagcaagu

SEQ ID NO: 9347 - RNA, 17 nt, Artificial Sequence
  Synthetic
cuccccgcucacuaagu

SEQ ID NO: 9348 - RNA, 17 nt, Artificial Sequence
  Synthetic
agcagaccugcgggagu

SEQ ID NO: 9349 - RNA, 17 nt, Artificial Sequence
  Synthetic
agccgcaaccugggagu

SEQ ID NO: 9350 - RNA, 17 nt, Artificial Sequence
  Synthetic
ccgggucuggacaaggu

SEQ ID NO: 9351 - RNA, 17 nt, Artificial Sequence
  Synthetic
agugaguagaggcaggu

SEQ ID NO: 9352 - RNA, 17 nt, Artificial Sequence
  Synthetic
ugccuuaagcuaguggu

SEQ ID NO: 9353 - RNA, 17 nt, Artificial Sequence
  Synthetic
cagaguugcaggaaugu

SEQ ID NO: 9354 - RNA, 17 nt, Artificial Sequence
  Synthetic
ucugggcugccuccugu

SEQ ID NO: 9355 - RNA, 17 nt, Artificial Sequence
  Synthetic
auccacgggcucugugu

SEQ ID NO: 9356 - RNA, 17 nt, Artificial Sequence
  Synthetic
agccagguccuuacauu

SEQ ID NO: 9357 - RNA, 17 nt, Artificial Sequence
  Synthetic
cuccuggaagcacacuu

SEQ ID NO: 9358 - RNA, 17 nt, Artificial Sequence
  Synthetic
uggagacagacucccuu

SEQ ID NO: 9359 - RNA, 17 nt, Artificial Sequence
  Synthetic
uuuugcugcauuaaguu

SEQ ID NO: 9360 - RNA, 17 nt, Artificial Sequence
  Synthetic
cccagcuccggcacuuu

SEQ ID NO: 9361 - RNA, 17 nt, Artificial Sequence
  Synthetic
ucuccuccagcccuuuu

SEQ ID NO: 9362 - RNA, 17 nt, Artificial Sequence
  Synthetic
cuccuccagcccuuuuu

SEQ ID NO: 9363 - RNA, 20 nt, Artificial Sequence
  Synthetic
ucagagaaucagacccaaaa

SEQ ID NO: 9364 - RNA, 20 nt, Artificial Sequence
  Synthetic
uagaaggagccagcaccaaa

SEQ ID NO: 9365 - RNA, 20 nt, Artificial Sequence
  Synthetic
caugagcuggcaaauagaaa

SEQ ID NO: 9366 - RNA, 20 nt, Artificial Sequence
  Synthetic
aucuccuuggcucugugaaa

SEQ ID NO: 9367 - RNA, 20 nt, Artificial Sequence
  Synthetic
auagaaggagccagcaccaa

SEQ ID NO: 9368 - RNA, 20 nt, Artificial Sequence
  Synthetic
uccuggaggaagaagaccaa

SEQ ID NO: 9369 - RNA, 20 nt, Artificial Sequence
  Synthetic
agauaagacauaagagccaa

SEQ ID NO: 9370 - RNA, 20 nt, Artificial Sequence
  Synthetic
aauccagcugucccuuccaa

SEQ ID NO: 9371 - RNA, 20 nt, Artificial Sequence
  Synthetic
aauguaaggaccuggcucaa

SEQ ID NO: 9372 - RNA, 20 nt, Artificial Sequence
  Synthetic
cccuggcuguuugaucucaa

SEQ ID NO: 9373 - RNA, 20 nt, Artificial Sequence
  Synthetic
aggucugcuggcuccaggaa

SEQ ID NO: 9374 - RNA, 20 nt, Artificial Sequence
  Synthetic
aacugauuuauccuugggaa

SEQ ID NO: 9375 - RNA, 20 nt, Artificial Sequence
  Synthetic
cucauuagcaucucaauuaa

SEQ ID NO: 9376 - RNA, 20 nt, Artificial Sequence
  Synthetic
acagcuaggagggcaacaca

SEQ ID NO: 9377 - RNA, 20 nt, Artificial Sequence
  Synthetic
ccuuugagaucaaacagcca

SEQ ID NO: 9378 - RNA, 20 nt, Artificial Sequence
  Synthetic
ccagagagcagacgaaucca

SEQ ID NO: 9379 - RNA, 20 nt, Artificial Sequence
  Synthetic
agcaagugggcagcccucca

SEQ ID NO: 9380 - RNA, 20 nt, Artificial Sequence
  Synthetic
aaauccagcugucccuucca

SEQ ID NO: 9381 - RNA, 20 nt, Artificial Sequence
  Synthetic
cugcugaaucuugacaagca

SEQ ID NO: 9382 - RNA, 20 nt, Artificial Sequence
  Synthetic
ugucuccaggaaggagagca

SEQ ID NO: 9383 - RNA, 20 nt, Artificial Sequence
  Synthetic
aucucaauuaaaggugagca

SEQ ID NO: 9384 - RNA, 20 nt, Artificial Sequence
  Synthetic
ccggagcccaggaagaggca

SEQ ID NO: 9385 - RNA, 20 nt, Artificial Sequence
  Synthetic
cccaggcccugcacgcggca

SEQ ID NO: 9386 - RNA, 20 nt, Artificial Sequence
  Synthetic
ccagguccuuacauugggca

SEQ ID NO: 9387 - RNA, 20 nt, Artificial Sequence
  Synthetic
agccuucccugccgcgugca

SEQ ID NO: 9388 - RNA, 20 nt, Artificial Sequence
  Synthetic
aagcaggcacugaaggugca

SEQ ID NO: 9389 - RNA, 20 nt, Artificial Sequence
  Synthetic
cucgaaagguggcccuauca

SEQ ID NO: 9390 - RNA, 20 nt, Artificial Sequence
  Synthetic
aaggcaguacuccaggcuca

SEQ ID NO: 9391 - RNA, 20 nt, Artificial Sequence
  Synthetic
caauguaaggaccuggcuca

SEQ ID NO: 9392 - RNA, 20 nt, Artificial Sequence
  Synthetic
ugggaguacuggaccugaga

SEQ ID NO: 9393 - RNA, 20 nt, Artificial Sequence
  Synthetic
cagagccgggaguuuuccga

SEQ ID NO: 9394 - RNA, 20 nt, Artificial Sequence
  Synthetic
acaauagagagggacagcga

SEQ ID NO: 9395 - RNA, 20 nt, Artificial Sequence
  Synthetic
aagggagucugucuccagga

SEQ ID NO: 9396 - RNA, 20 nt, Artificial Sequence
  Synthetic
uccugagcccacagcuagga

SEQ ID NO: 9397 - RNA, 20 nt, Artificial Sequence
  Synthetic
aaccuuguccagacccggga

SEQ ID NO: 9398 - RNA, 20 nt, Artificial Sequence
  Synthetic
ccuggaugugaaagccggga

SEQ ID NO: 9399 - RNA, 20 nt, Artificial Sequence
  Synthetic
agaugacaccuucucuggga

SEQ ID NO: 9400 - RNA, 20 nt, Artificial Sequence
  Synthetic
aaacugauuuauccuuggga

SEQ ID NO: 9401 - RNA, 20 nt, Artificial Sequence
  Synthetic
uuugucugcuggcuugugga

SEQ ID NO: 9402 - RNA, 20 nt, Artificial Sequence
  Synthetic
cgggucuggacaagguugga

SEQ ID NO: 9403 - RNA, 20 nt, Artificial Sequence
  Synthetic
cucuucucugcagggccuga

SEQ ID NO: 9404 - RNA, 20 nt, Artificial Sequence
  Synthetic
cgggcucugugugggaguga

SEQ ID NO: 9405 - RNA, 20 nt, Artificial Sequence
  Synthetic
ccgcugcaccugucagguga

SEQ ID NO: 9406 - RNA, 20 nt, Artificial Sequence
  Synthetic
ucuccucugcuucccugaua

SEQ ID NO: 9407 - RNA, 20 nt, Artificial Sequence
  Synthetic
aagggagacuggaguuucua

SEQ ID NO: 9408 - RNA, 20 nt, Artificial Sequence
  Synthetic
uuuggaauccugguugacac

SEQ ID NO: 9409 - RNA, 20 nt, Artificial Sequence
  Synthetic
agcccuccaagggcacccac

SEQ ID NO: 9410 - RNA, 20 nt, Artificial Sequence
  Synthetic
cgcuuccucacgggccccac

SEQ ID NO: 9411 - RNA, 20 nt, Artificial Sequence
  Synthetic
cagagagcagacgaauccac

SEQ ID NO: 9412 - RNA, 20 nt, Artificial Sequence
  Synthetic
caggggcuuuagacgcagac

SEQ ID NO: 9413 - RNA, 20 nt, Artificial Sequence
  Synthetic
cggccagggauggaagcgac

SEQ ID NO: 9414 - RNA, 20 nt, Artificial Sequence
  Synthetic
cucccagguugcggcuggac

SEQ ID NO: 9415 - RNA, 20 nt, Artificial Sequence
  Synthetic
uccaggcucaggguccaacc

SEQ ID NO: 9416 - RNA, 20 nt, Artificial Sequence
  Synthetic
agugaaagccggugucaacc

SEQ ID NO: 9417 - RNA, 20 nt, Artificial Sequence
  Synthetic
ccugagcauugauacacacc

SEQ ID NO: 9418 - RNA, 20 nt, Artificial Sequence
  Synthetic
ccuccaaccuuguccagacc

SEQ ID NO: 9419 - RNA, 20 nt, Artificial Sequence
  Synthetic
ccaugcccaauguaaggacc

SEQ ID NO: 9420 - RNA, 20 nt, Artificial Sequence
  Synthetic
agcaggaaagaggagggacc

SEQ ID NO: 9421 - RNA, 20 nt, Artificial Sequence
  Synthetic
cuccaaccuuguccagaccc

SEQ ID NO: 9422 - RNA, 20 nt, Artificial Sequence
  Synthetic
ccugauucugucucugcccc

SEQ ID NO: 9423 - RNA, 20 nt, Artificial Sequence
  Synthetic
ugcaggccuaucuccucccc

SEQ ID NO: 9424 - RNA, 20 nt, Artificial Sequence
  Synthetic
uggacacagacccggagccc

SEQ ID NO: 9425 - RNA, 20 nt, Artificial Sequence
  Synthetic
auuccugucgcuuccauccc

SEQ ID NO: 9426 - RNA, 20 nt, Artificial Sequence
  Synthetic
aacgaauuucuccuccuccc

SEQ ID NO: 9427 - RNA, 20 nt, Artificial Sequence
  Synthetic
accuuugagaucaaacagcc

SEQ ID NO: 9428 - RNA, 20 nt, Artificial Sequence
  Synthetic
agcgggcgggcuccccagcc

SEQ ID NO: 9429 - RNA, 20 nt, Artificial Sequence
  Synthetic
acaaggagaaggggccagcc

SEQ ID NO: 9430 - RNA, 20 nt, Artificial Sequence
  Synthetic
accagguuggacccugagcc

SEQ ID NO: 9431 - RNA, 20 nt, Artificial Sequence
  Synthetic
acuccagucucccuugagcc

SEQ ID NO: 9432 - RNA, 20 nt, Artificial Sequence
  Synthetic
acacuguuggcugccaggcc

SEQ ID NO: 9433 - RNA, 20 nt, Artificial Sequence
  Synthetic
accugacaggugcagcggcc

SEQ ID NO: 9434 - RNA, 20 nt, Artificial Sequence
  Synthetic
ucccugccgcgugcagggcc

SEQ ID NO: 9435 - RNA, 20 nt, Artificial Sequence
  Synthetic
uuuuuacacuguuggcugcc

SEQ ID NO: 9436 - RNA, 20 nt, Artificial Sequence
  Synthetic
ccuucccggcuuucacaucc

SEQ ID NO: 9437 - RNA, 20 nt, Artificial Sequence
  Synthetic
aggagcugagacacagaucc

SEQ ID NO: 9438 - RNA, 20 nt, Artificial Sequence
  Synthetic
uccuuccuucggaaaacucc

SEQ ID NO: 9439 - RNA, 20 nt, Artificial Sequence
  Synthetic
aagagaaaaggcaguacucc

SEQ ID NO: 9440 - RNA, 20 nt, Artificial Sequence
  Synthetic
uggaggcagcccagaccucc

SEQ ID NO: 9441 - RNA, 20 nt, Artificial Sequence
  Synthetic
agcuucaccugggccccucc

SEQ ID NO: 9442 - RNA, 20 nt, Artificial Sequence
  Synthetic
uuucugcccuccuguccucc

SEQ ID NO: 9443 - RNA, 20 nt, Artificial Sequence
  Synthetic
cuugcugagccucuagcucc

SEQ ID NO: 9444 - RNA, 20 nt, Artificial Sequence
  Synthetic
cccgcaggucugcuggcucc

SEQ ID NO: 9445 - RNA, 20 nt, Artificial Sequence
  Synthetic
accaaagggagucugucucc

SEQ ID NO: 9446 - RNA, 20 nt, Artificial Sequence
  Synthetic
caggggcgauuacacauucc

SEQ ID NO: 9447 - RNA, 20 nt, Artificial Sequence
  Synthetic
uccccccuugcucuccuucc

SEQ ID NO: 9448 - RNA, 20 nt, Artificial Sequence
  Synthetic
ugcaacucugugaccacagc

SEQ ID NO: 9449 - RNA, 20 nt, Artificial Sequence
  Synthetic
uccaucccuggccggccagc

SEQ ID NO: 9450 - RNA, 20 nt, Artificial Sequence
  Synthetic
caucucaauuaaaggugagc

SEQ ID NO: 9451 - RNA, 20 nt, Artificial Sequence
  Synthetic
ugacaagcaaggaguuuagc

SEQ ID NO: 9452 - RNA, 20 nt, Artificial Sequence
  Synthetic
aggcagcgcgagggccacgc

SEQ ID NO: 9453 - RNA, 20 nt, Artificial Sequence
  Synthetic
uggcuggggagcccgcccgc

SEQ ID NO: 9454 - RNA, 20 nt, Artificial Sequence
  Synthetic
cuuuuggccccaacucccgc

SEQ ID NO: 9455 - RNA, 20 nt, Artificial Sequence
  Synthetic
acccucuuccuuuccagcgc

SEQ ID NO: 9456 - RNA, 20 nt, Artificial Sequence
  Synthetic
ucgaggucagggccagaggc

SEQ ID NO: 9457 - RNA, 20 nt, Artificial Sequence
  Synthetic
acgcagacaggcaaggaggc

SEQ ID NO: 9458 - RNA, 20 nt, Artificial Sequence
  Synthetic
acccaggcccugcacgcggc

SEQ ID NO: 9459 - RNA, 20 nt, Artificial Sequence
  Synthetic
ucccacucccagguugcggc

SEQ ID NO: 9460 - RNA, 20 nt, Artificial Sequence
  Synthetic
caauuaaaggugagcagggc

SEQ ID NO: 9461 - RNA, 20 nt, Artificial Sequence
  Synthetic
ucccuggccggccagcgggc

SEQ ID NO: 9462 - RNA, 20 nt, Artificial Sequence
  Synthetic
ugagaaggcggacucugggc

SEQ ID NO: 9463 - RNA, 20 nt, Artificial Sequence
  Synthetic
cugucgcuuccaucccuggc

SEQ ID NO: 9464 - RNA, 20 nt, Artificial Sequence
  Synthetic
ccuggagccagcagaccugc

SEQ ID NO: 9465 - RNA, 20 nt, Artificial Sequence
  Synthetic
aagagagaagaggucucugc

SEQ ID NO: 9466 - RNA, 20 nt, Artificial Sequence
  Synthetic
cccaacucccgcaggucugc

SEQ ID NO: 9467 - RNA, 20 nt, Artificial Sequence
  Synthetic
caggcugggccuuugucugc

SEQ ID NO: 9468 - RNA, 20 nt, Artificial Sequence
  Synthetic
cagccuucccugccgcgugc

SEQ ID NO: 9469 - RNA, 20 nt, Artificial Sequence
  Synthetic
aaagcaggcacugaaggugc

SEQ ID NO: 9470 - RNA, 20 nt, Artificial Sequence
  Synthetic
uucgucugcucucugggugc

SEQ ID NO: 9471 - RNA, 20 nt, Artificial Sequence
  Synthetic
accuuaucuuauuguauugc

SEQ ID NO: 9472 - RNA, 20 nt, Artificial Sequence
  Synthetic
ugcuguggucacagaguugc

SEQ ID NO: 9473 - RNA, 20 nt, Artificial Sequence
  Synthetic
ccuggggcagagacagaauc

SEQ ID NO: 9474 - RNA, 20 nt, Artificial Sequence
  Synthetic
agacagacucaugggggauc

SEQ ID NO: 9475 - RNA, 20 nt, Artificial Sequence
  Synthetic
acucgaaagguggcccuauc

SEQ ID NO: 9476 - RNA, 20 nt, Artificial Sequence
  Synthetic
uaagugggagcagcgcacuc

SEQ ID NO: 9477 - RNA, 20 nt, Artificial Sequence
  Synthetic
aaaagggcuggaggagacuc

SEQ ID NO: 9478 - RNA, 20 nt, Artificial Sequence
  Synthetic
cacaggucagccucacccuc

SEQ ID NO: 9479 - RNA, 20 nt, Artificial Sequence
  Synthetic
cguggcccucgcgcugccuc

SEQ ID NO: 9480 - RNA, 20 nt, Artificial Sequence
  Synthetic
aaaggcaguacuccaggcuc

SEQ ID NO: 9481 - RNA, 20 nt, Artificial Sequence
  Synthetic
cucaugggggaucggggcuc

SEQ ID NO: 9482 - RNA, 20 nt, Artificial Sequence
  Synthetic
cccgguguguaucaaugcuc

SEQ ID NO: 9483 - RNA, 20 nt, Artificial Sequence
  Synthetic
ccguggauucgucugcucuc

SEQ ID NO: 9484 - RNA, 20 nt, Artificial Sequence
  Synthetic
cuggaguuucuaggggucuc

SEQ ID NO: 9485 - RNA, 20 nt, Artificial Sequence
  Synthetic
aucccccaugagucugucuc

SEQ ID NO: 9486 - RNA, 20 nt, Artificial Sequence
  Synthetic
agcagagaugacaccuucuc

SEQ ID NO: 9487 - RNA, 20 nt, Artificial Sequence
  Synthetic
ugcccagaguccgccuucuc

SEQ ID NO: 9488 - RNA, 20 nt, Artificial Sequence
  Synthetic
ucaggacacagcucgagguc

SEQ ID NO: 9489 - RNA, 20 nt, Artificial Sequence
  Synthetic
aagaauugcaaugccugguc

SEQ ID NO: 9490 - RNA, 20 nt, Artificial Sequence
  Synthetic
uaagcuagugguuggauuuc

SEQ ID NO: 9491 - RNA, 20 nt, Artificial Sequence
  Synthetic
auaaggaguggagugccaag

SEQ ID NO: 9492 - RNA, 20 nt, Artificial Sequence
  Synthetic
cagacccggagcccaggaag

SEQ ID NO: 9493 - RNA, 20 nt, Artificial Sequence
  Synthetic
cuguggggcccgugaggaag

SEQ ID NO: 9494 - RNA, 20 nt, Artificial Sequence
  Synthetic
ucuccuccccgcucacuaag

SEQ ID NO: 9495 - RNA, 20 nt, Artificial Sequence
  Synthetic
cgcuaaguagauagccccag

SEQ ID NO: 9496 - RNA, 20 nt, Artificial Sequence
  Synthetic
uuccaucccuggccggccag

SEQ ID NO: 9497 - RNA, 20 nt, Artificial Sequence
  Synthetic
cagcucgaggucagggccag

SEQ ID NO: 9498 - RNA, 20 nt, Artificial Sequence
  Synthetic
uggcccuaucagggaagcag

SEQ ID NO: 9499 - RNA, 20 nt, Artificial Sequence
  Synthetic
caacucugugaccacagcag

SEQ ID NO: 9500 - RNA, 20 nt, Artificial Sequence
  Synthetic
cucugggauauguggggcag

SEQ ID NO: 9501 - RNA, 20 nt, Artificial Sequence
  Synthetic
agaaggcggacucugggcag

SEQ ID NO: 9502 - RNA, 20 nt, Artificial Sequence
  Synthetic
cugagggccuagagugagag

SEQ ID NO: 9503 - RNA, 20 nt, Artificial Sequence
  Synthetic
ugcagcaaaaggauaaggag

SEQ ID NO: 9504 - RNA, 20 nt, Artificial Sequence
  Synthetic
accuuguccagacccgggag

SEQ ID NO: 9505 - RNA, 20 nt, Artificial Sequence
  Synthetic
aaggggccagccaggcugag

SEQ ID NO: 9506 - RNA, 20 nt, Artificial Sequence
  Synthetic
agcugagggccuagagugag

SEQ ID NO: 9507 - RNA, 20 nt, Artificial Sequence
  Synthetic
cgcugcucccacuuagugag

SEQ ID NO: 9508 - RNA, 20 nt, Artificial Sequence
  Synthetic
cgcugcaccugucaggugag

SEQ ID NO: 9509 - RNA, 20 nt, Artificial Sequence
  Synthetic
caagggcuaggggagccuag

SEQ ID NO: 9510 - RNA, 20 nt, Artificial Sequence
  Synthetic
agugugcuuccaggagcuag

SEQ ID NO: 9511 - RNA, 20 nt, Artificial Sequence
  Synthetic
acauaagagccaagggcuag

SEQ ID NO: 9512 - RNA, 20 nt, Artificial Sequence
  Synthetic
agggagacuggaguuucuag

SEQ ID NO: 9513 - RNA, 20 nt, Artificial Sequence
  Synthetic
cacaacccaggcccugcacg

SEQ ID NO: 9514 - RNA, 20 nt, Artificial Sequence
  Synthetic
cugagcauugauacacaccg

SEQ ID NO: 9515 - RNA, 20 nt, Artificial Sequence
  Synthetic
ucacucccacacagagcccg

SEQ ID NO: 9516 - RNA, 20 nt, Artificial Sequence
  Synthetic
cgaaggaaggagggcucccg

SEQ ID NO: 9517 - RNA, 20 nt, Artificial Sequence
  Synthetic
cugcucccacuuagugagcg

SEQ ID NO: 9518 - RNA, 20 nt, Artificial Sequence
  Synthetic
aauuaaaggugagcagggcg

SEQ ID NO: 9519 - RNA, 20 nt, Artificial Sequence
  Synthetic
caagguuggaggggguggcg

SEQ ID NO: 9520 - RNA, 20 nt, Artificial Sequence
  Synthetic
uguguccacaguguccugcg

SEQ ID NO: 9521 - RNA, 20 nt, Artificial Sequence
  Synthetic
cagaaucaggacacagcucg

SEQ ID NO: 9522 - RNA, 20 nt, Artificial Sequence
  Synthetic
cuaggacaaaacucgaaagg

SEQ ID NO: 9523 - RNA, 20 nt, Artificial Sequence
  Synthetic
uuagacgcagacaggcaagg

SEQ ID NO: 9524 - RNA, 20 nt, Artificial Sequence
  Synthetic
uuccucacgggccccacagg

SEQ ID NO: 9525 - RNA, 20 nt, Artificial Sequence
  Synthetic
uggggaaccgggaggacagg

SEQ ID NO: 9526 - RNA, 20 nt, Artificial Sequence
  Synthetic
acugagugaguagaggcagg

SEQ ID NO: 9527 - RNA, 20 nt, Artificial Sequence
  Synthetic
uaaguagauagccccagagg

SEQ ID NO: 9528 - RNA, 20 nt, Artificial Sequence
  Synthetic
ugagggccuagagugagagg

SEQ ID NO: 9529 - RNA, 20 nt, Artificial Sequence
  Synthetic
auccugagcccacagcuagg

SEQ ID NO: 9530 - RNA, 20 nt, Artificial Sequence
  Synthetic
aggugaagcugggggcuagg

SEQ ID NO: 9531 - RNA, 20 nt, Artificial Sequence
  Synthetic
ugagcauugauacacaccgg

SEQ ID NO: 9532 - RNA, 20 nt, Artificial Sequence
  Synthetic
auuaaaggugagcagggcgg

SEQ ID NO: 9533 - RNA, 20 nt, Artificial Sequence
  Synthetic
caggcacugaaggugcaggg

SEQ ID NO: 9534 - RNA, 20 nt, Artificial Sequence
  Synthetic
cugagcaccuuauugcaggg

SEQ ID NO: 9535 - RNA, 20 nt, Artificial Sequence
  Synthetic
caaccuuguccagacccggg

SEQ ID NO: 9536 - RNA, 20 nt, Artificial Sequence
  Synthetic
aucccuggccggccagcggg

SEQ ID NO: 9537 - RNA, 20 nt, Artificial Sequence
  Synthetic
uuaaaggugagcagggcggg

SEQ ID NO: 9538 - RNA, 20 nt, Artificial Sequence
  Synthetic
cucccacuuagugagcgggg

SEQ ID NO: 9539 - RNA, 20 nt, Artificial Sequence
  Synthetic
cuggacaagguuggaggggg

SEQ ID NO: 9540 - RNA, 20 nt, Artificial Sequence
  Synthetic
acgccuagacaggcccuggg

SEQ ID NO: 9541 - RNA, 20 nt, Artificial Sequence
  Synthetic
uuccugagacagacucaugg

SEQ ID NO: 9542 - RNA, 20 nt, Artificial Sequence
  Synthetic
agcugagacacagauccugg

SEQ ID NO: 9543 - RNA, 20 nt, Artificial Sequence
  Synthetic
ucagacccaaaaagggcugg

SEQ ID NO: 9544 - RNA, 20 nt, Artificial Sequence
  Synthetic
cuuugucugcuggcuugugg

SEQ ID NO: 9545 - RNA, 20 nt, Artificial Sequence
  Synthetic
ugaccugugggugcccuugg

SEQ ID NO: 9546 - RNA, 20 nt, Artificial Sequence
  Synthetic
ccgggucuggacaagguugg

SEQ ID NO: 9547 - RNA, 20 nt, Artificial Sequence
  Synthetic
cuuccugagacagacucaug

SEQ ID NO: 9548 - RNA, 20 nt, Artificial Sequence
  Synthetic
cugaaggugcagggaggaug

SEQ ID NO: 9549 - RNA, 20 nt, Artificial Sequence
  Synthetic
cuaggggucucugggauaug

SEQ ID NO: 9550 - RNA, 20 nt, Artificial Sequence
  Synthetic
uccuggagccagcagaccug

SEQ ID NO: 9551 - RNA, 20 nt, Artificial Sequence
  Synthetic
cugagggugaggcugaccug

SEQ ID NO: 9552 - RNA, 20 nt, Artificial Sequence
  Synthetic
ucucuucucugcagggccug

SEQ ID NO: 9553 - RNA, 20 nt, Artificial Sequence
  Synthetic
uuguguugcccuccuagcug

SEQ ID NO: 9554 - RNA, 20 nt, Artificial Sequence
  Synthetic
caggugcagcggccuggcug

SEQ ID NO: 9555 - RNA, 20 nt, Artificial Sequence
  Synthetic
auguguaaucgccccugcug

SEQ ID NO: 9556 - RNA, 20 nt, Artificial Sequence
  Synthetic
agaauucuccuccuccucug

SEQ ID NO: 9557 - RNA, 20 nt, Artificial Sequence
  Synthetic
ucaggguccaaccuggucug

SEQ ID NO: 9558 - RNA, 20 nt, Artificial Sequence
  Synthetic
aaggauaaaucaguuuucug

SEQ ID NO: 9559 - RNA, 20 nt, Artificial Sequence
  Synthetic
cugggauauguggggcagug

SEQ ID NO: 9560 - RNA, 20 nt, Artificial Sequence
  Synthetic
acgggcucugugugggagug

SEQ ID NO: 9561 - RNA, 20 nt, Artificial Sequence
  Synthetic
ugccuccuguggggcccgug

SEQ ID NO: 9562 - RNA, 20 nt, Artificial Sequence
  Synthetic
ugagugaguagaggcaggug

SEQ ID NO: 9563 - RNA, 20 nt, Artificial Sequence
  Synthetic
cucugcagggccugagggug

SEQ ID NO: 9564 - RNA, 20 nt, Artificial Sequence
  Synthetic
aggggucucugggauaugug

SEQ ID NO: 9565 - RNA, 20 nt, Artificial Sequence
  Synthetic
acucugggcugccuccugug

SEQ ID NO: 9566 - RNA, 20 nt, Artificial Sequence
  Synthetic
acgaauccacgggcucugug

SEQ ID NO: 9567 - RNA, 20 nt, Artificial Sequence
  Synthetic
cgugcagggccuggguugug

SEQ ID NO: 9568 - RNA, 20 nt, Artificial Sequence
  Synthetic
cagcagaccugcgggaguug

SEQ ID NO: 9569 - RNA, 20 nt, Artificial Sequence
  Synthetic
cugagguuagaaaacaaaau

SEQ ID NO: 9570 - RNA, 20 nt, Artificial Sequence
  Synthetic
cuugagccagguccuuacau

SEQ ID NO: 9571 - RNA, 20 nt, Artificial Sequence
  Synthetic
acagcgaaggacagagagau

SEQ ID NO: 9572 - RNA, 20 nt, Artificial Sequence
  Synthetic
uacacaccgggggaggagau

SEQ ID NO: 9573 - RNA, 20 nt, Artificial Sequence
  Synthetic
cucuccucugcuucccugau

SEQ ID NO: 9574 - RNA, 20 nt, Artificial Sequence
  Synthetic
aggaggagaaauucguugau

SEQ ID NO: 9575 - RNA, 20 nt, Artificial Sequence
  Synthetic
cucccgagggcaggugaacu

SEQ ID NO: 9576 - RNA, 20 nt, Artificial Sequence
  Synthetic
cuagcuccuggaagcacacu

SEQ ID NO: 9577 - RNA, 20 nt, Artificial Sequence
  Synthetic
cucucuccuugcucaccacu

SEQ ID NO: 9578 - RNA, 20 nt, Artificial Sequence
  Synthetic
aaaaagggcuggaggagacu

SEQ ID NO: 9579 - RNA, 20 nt, Artificial Sequence
  Synthetic
ucccagguugcggcuggacu

SEQ ID NO: 9580 - RNA, 20 nt, Artificial Sequence
  Synthetic
ucccaguccagccgcaaccu

SEQ ID NO: 9581 - RNA, 20 nt, Artificial Sequence
  Synthetic
ccuagcccccagcuucaccu

SEQ ID NO: 9582 - RNA, 20 nt, Artificial Sequence
  Synthetic
cccuaggcuccccuagcccu

SEQ ID NO: 9583 - RNA, 20 nt, Artificial Sequence
  Synthetic
cacacgccuagacaggcccu

SEQ ID NO: 9584 - RNA, 20 nt, Artificial Sequence
  Synthetic
ugggggcuaggcggggcccu

SEQ ID NO: 9585 - RNA, 20 nt, Artificial Sequence
  Synthetic
acucccaguucaccugcccu

SEQ ID NO: 9586 - RNA, 20 nt, Artificial Sequence
  Synthetic
cccugccgcgugcagggccu

SEQ ID NO: 9587 - RNA, 20 nt, Artificial Sequence
  Synthetic
ugggugcuggguuaucuccu

SEQ ID NO: 9588 - RNA, 20 nt, Artificial Sequence
  Synthetic
uccuggagcccugcaguccu

SEQ ID NO: 9589 - RNA, 20 nt, Artificial Sequence
  Synthetic
aggauccugagcccacagcu

SEQ ID NO: 9590 - RNA, 20 nt, Artificial Sequence
  Synthetic
uguguaucaaugcucaggcu

SEQ ID NO: 9591 - RNA, 20 nt, Artificial Sequence
  Synthetic
cgcagacaggcaaggaggcu

SEQ ID NO: 9592 - RNA, 20 nt, Artificial Sequence
  Synthetic
agacauaagagccaagggcu

SEQ ID NO: 9593 - RNA, 20 nt, Artificial Sequence
  Synthetic
acaggugcagcggccuggcu

SEQ ID NO: 9594 - RNA, 20 nt, Artificial Sequence
  Synthetic
ucgucugcucucugggugcu

SEQ ID NO: 9595 - RNA, 20 nt, Artificial Sequence
  Synthetic
ugaccacauuccugcacucu

SEQ ID NO: 9596 - RNA, 20 nt, Artificial Sequence
  Synthetic
cguggauucgucugcucucu

SEQ ID NO: 9597 - RNA, 20 nt, Artificial Sequence
  Synthetic
uggaguuucuaggggucucu

SEQ ID NO: 9598 - RNA, 20 nt, Artificial Sequence
  Synthetic
ugcagggcuccaggaggucu

SEQ ID NO: 9599 - RNA, 20 nt, Artificial Sequence
  Synthetic
agcagaggagaggccguucu

SEQ ID NO: 9600 - RNA, 20 nt, Artificial Sequence
  Synthetic
caagggagacuggaguuucu

SEQ ID NO: 9601 - RNA, 20 nt, Artificial Sequence
  Synthetic
cuccuccccgcucacuaagu

SEQ ID NO: 9602 - RNA, 20 nt, Artificial Sequence
  Synthetic
ucugggauauguggggcagu

SEQ ID NO: 9603 - RNA, 20 nt, Artificial Sequence
  Synthetic
uccagccgcaaccugggagu

SEQ ID NO: 9604 - RNA, 20 nt, Artificial Sequence
  Synthetic
cucccgggucuggacaaggu

SEQ ID NO: 9605 - RNA, 20 nt, Artificial Sequence
  Synthetic
cugagugaguagaggcaggu

SEQ ID NO: 9606 - RNA, 20 nt, Artificial Sequence
  Synthetic
ugggagcagcgcacucaggu

SEQ ID NO: 9607 - RNA, 20 nt, Artificial Sequence
  Synthetic
ugcugccuuaagcuaguggu

SEQ ID NO: 9608 - RNA, 20 nt, Artificial Sequence
  Synthetic
agggaggagugggagaaugu

SEQ ID NO: 9609 - RNA, 20 nt, Artificial Sequence
  Synthetic
ucacagaguugcaggaaugu

SEQ ID NO: 9610 - RNA, 20 nt, Artificial Sequence
  Synthetic
uaggggucucugggauaugu

SEQ ID NO: 9611 - RNA, 20 nt, Artificial Sequence
  Synthetic
ucuguucuuuuuuacacugu

SEQ ID NO: 9612 - RNA, 20 nt, Artificial Sequence
  Synthetic
ugagggugaggcugaccugu

SEQ ID NO: 9613 - RNA, 20 nt, Artificial Sequence
  Synthetic
cacucugggcugccuccugu

SEQ ID NO: 9614 - RNA, 20 nt, Artificial Sequence
  Synthetic
uguguugcccuccuagcugu

SEQ ID NO: 9615 - RNA, 20 nt, Artificial Sequence
  Synthetic
cgaauccacgggcucugugu

SEQ ID NO: 9616 - RNA, 20 nt, Artificial Sequence
  Synthetic
uugagccagguccuuacauu

SEQ ID NO: 9617 - RNA, 20 nt, Artificial Sequence
  Synthetic
uagcuccuggaagcacacuu

SEQ ID NO: 9618 - RNA, 20 nt, Artificial Sequence
  Synthetic
uccuggagacagacucccuu

SEQ ID NO: 9619 - RNA, 20 nt, Artificial Sequence
  Synthetic
cucgggagcccuccuuccuu

SEQ ID NO: 9620 - RNA, 20 nt, Artificial Sequence
  Synthetic
uccuuuugcugcauuaaguu

SEQ ID NO: 9621 - RNA, 20 nt, Artificial Sequence
  Synthetic
ccagcagaccugcgggaguu

SEQ ID NO: 9622 - RNA, 20 nt, Artificial Sequence
  Synthetic
uuaaguuuggaaagagauuu

SEQ ID NO: 9623 - RNA, 20 nt, Artificial Sequence
  Synthetic
aagcccagcuccggcacuuu

SEQ ID NO: 9624 - RNA, 20 nt, Artificial Sequence
  Synthetic
agucuccuccagcccuuuuu

SEQ ID NO: 9625 - RNA, 17 nt, Artificial Sequence
  Synthetic
gggggcagagacagaaa

SEQ ID NO: 9626 - RNA, 17 nt, Artificial Sequence
  Synthetic
gagagggggcaaggcaa

SEQ ID NO: 9627 - RNA, 17 nt, Artificial Sequence
  Synthetic
guaaggaccuggcucaa

SEQ ID NO: 9628 - RNA, 17 nt, Artificial Sequence
  Synthetic
gaagaagaccaaaggaa

SEQ ID NO: 9629 - RNA, 17 nt, Artificial Sequence
  Synthetic
ggcaaauagaaaaggca

SEQ ID NO: 9630 - RNA, 17 nt, Artificial Sequence
  Synthetic
gagcccaggaagaggca

SEQ ID NO: 9631 - RNA, 17 nt, Artificial Sequence
  Synthetic
ggaagccuucccagaga

SEQ ID NO: 9632 - RNA, 17 nt, Artificial Sequence
  Synthetic
gagggagacaauagaga

SEQ ID NO: 9633 - RNA, 17 nt, Artificial Sequence
  Synthetic
ggccagccaggcugaga

SEQ ID NO: 9634 - RNA, 17 nt, Artificial Sequence
  Synthetic
ggaagaagaccaaagga

SEQ ID NO: 9635 - RNA, 17 nt, Artificial Sequence
  Synthetic
gaggcugggggacagga

SEQ ID NO: 9636 - RNA, 17 nt, Artificial Sequence
  Synthetic
gagauagggauggagga

SEQ ID NO: 9637 - RNA, 17 nt, Artificial Sequence
  Synthetic
gaaagguggaggaggga

SEQ ID NO: 9638 - RNA, 17 nt, Artificial Sequence
  Synthetic
ggacagagagauaggga

SEQ ID NO: 9639 - RNA, 17 nt, Artificial Sequence
  Synthetic
gggaaagcaggcacuga

SEQ ID NO: 9640 - RNA, 17 nt, Artificial Sequence
  Synthetic
gacaggauggcagguga

SEQ ID NO: 9641 - RNA, 17 nt, Artificial Sequence
  Synthetic
gggccuggguggggaac

SEQ ID NO: 9642 - RNA, 17 nt, Artificial Sequence
  Synthetic
ggccuggguggggaacc

SEQ ID NO: 9643 - RNA, 17 nt, Artificial Sequence
  Synthetic
gaauuucuccuccuccc

SEQ ID NO: 9644 - RNA, 17 nt, Artificial Sequence
  Synthetic
gaggaggagucagagcc

SEQ ID NO: 9645 - RNA, 17 nt, Artificial Sequence
  Synthetic
gccaggcugagagggcc

SEQ ID NO: 9646 - RNA, 17 nt, Artificial Sequence
  Synthetic
gccucuuccugggcucc

SEQ ID NO: 9647 - RNA, 17 nt, Artificial Sequence
  Synthetic
gcaggucugcuggcucc

SEQ ID NO: 9648 - RNA, 17 nt, Artificial Sequence
  Synthetic
gaagaggcagggaaagc

SEQ ID NO: 9649 - RNA, 17 nt, Artificial Sequence
  Synthetic
gccagaaagaggagagc

SEQ ID NO: 9650 - RNA, 17 nt, Artificial Sequence
  Synthetic
ggauuucaggcaugagc

SEQ ID NO: 9651 - RNA, 17 nt, Artificial Sequence
  Synthetic
gcucccacuuagugagc

SEQ ID NO: 9652 - RNA, 17 nt, Artificial Sequence
  Synthetic
ggagcccaggaagaggc

SEQ ID NO: 9653 - RNA, 17 nt, Artificial Sequence
  Synthetic
gggagaggaagagaggc

SEQ ID NO: 9654 - RNA, 17 nt, Artificial Sequence
  Synthetic
gagagggagugagaggc

SEQ ID NO: 9655 - RNA, 17 nt, Artificial Sequence
  Synthetic
gauuagagagaggaggc

SEQ ID NO: 9656 - RNA, 17 nt, Artificial Sequence
  Synthetic
ggcuuguggagggaggc

SEQ ID NO: 9657 - RNA, 17 nt, Artificial Sequence
  Synthetic
ggagggcucccgagggc

SEQ ID NO: 9658 - RNA, 17 nt, Artificial Sequence
  Synthetic
ggcccucucagccuggc

SEQ ID NO: 9659 - RNA, 17 nt, Artificial Sequence
  Synthetic
gaggcagcccagagugc

SEQ ID NO: 9660 - RNA, 17 nt, Artificial Sequence
  Synthetic
gaauucuccuccuccuc

SEQ ID NO: 9661 - RNA, 17 nt, Artificial Sequence
  Synthetic
ggaggcaggccagaaag

SEQ ID NO: 9662 - RNA, 17 nt, Artificial Sequence
  Synthetic
gacaggagggcagaaag

SEQ ID NO: 9663 - RNA, 17 nt, Artificial Sequence
  Synthetic
ggcaacacaaggagaag

SEQ ID NO: 9664 - RNA, 17 nt, Artificial Sequence
  Synthetic
gggggggagaggaagag

SEQ ID NO: 9665 - RNA, 17 nt, Artificial Sequence
  Synthetic
ggugagcaaggagagag

SEQ ID NO: 9666 - RNA, 17 nt, Artificial Sequence
  Synthetic
gaggcaggauuagagag

SEQ ID NO: 9667 - RNA, 17 nt, Artificial Sequence
  Synthetic
gaggagggagggaggag

SEQ ID NO: 9668 - RNA, 17 nt, Artificial Sequence
  Synthetic
gagcagggcggggggag

SEQ ID NO: 9669 - RNA, 17 nt, Artificial Sequence
  Synthetic
gggccagccaggcugag

SEQ ID NO: 9670 - RNA, 17 nt, Artificial Sequence
  Synthetic
gauagagagggagugag

SEQ ID NO: 9671 - RNA, 17 nt, Artificial Sequence
  Synthetic
gguuggaggggguggcg

SEQ ID NO: 9672 - RNA, 17 nt, Artificial Sequence
  Synthetic
gcuggcuccaggaaagg

SEQ ID NO: 9673 - RNA, 17 nt, Artificial Sequence
  Synthetic
gagggggcaaggcaagg

SEQ ID NO: 9674 - RNA, 17 nt, Artificial Sequence
  Synthetic
gacugcagggcuccagg

SEQ ID NO: 9675 - RNA, 17 nt, Artificial Sequence
  Synthetic
gagugaguagaggcagg

SEQ ID NO: 9676 - RNA, 17 nt, Artificial Sequence
  Synthetic
gagcaaggagagagagg

SEQ ID NO: 9677 - RNA, 17 nt, Artificial Sequence
  Synthetic
gcaggauuagagagagg

SEQ ID NO: 9678 - RNA, 17 nt, Artificial Sequence
  Synthetic
gaggagggaccaggagg

SEQ ID NO: 9679 - RNA, 17 nt, Artificial Sequence
  Synthetic
gauagccccagaggagg

SEQ ID NO: 9680 - RNA, 17 nt, Artificial Sequence
  Synthetic
ggggggaggggcugagg

SEQ ID NO: 9681 - RNA, 17 nt, Artificial Sequence
  Synthetic
gcaccugucaggugagg

SEQ ID NO: 9682 - RNA, 17 nt, Artificial Sequence
  Synthetic
ggcagagacagaaaggg

SEQ ID NO: 9683 - RNA, 17 nt, Artificial Sequence
  Synthetic
gcuggaaaggaagaggg

SEQ ID NO: 9684 - RNA, 17 nt, Artificial Sequence
  Synthetic
ggaaagguggaggaggg

SEQ ID NO: 9685 - RNA, 17 nt, Artificial Sequence
  Synthetic
gggggcaaggcaagggg

SEQ ID NO: 9686 - RNA, 17 nt, Artificial Sequence
  Synthetic
gacaagguuggaggggg

SEQ ID NO: 9687 - RNA, 17 nt, Artificial Sequence
  Synthetic
gugagcagggcgggggg

SEQ ID NO: 9688 - RNA, 17 nt, Artificial Sequence
  Synthetic
ggcugagagggccuggg

SEQ ID NO: 9689 - RNA, 17 nt, Artificial Sequence
  Synthetic
gaguagaggcagguggg

SEQ ID NO: 9690 - RNA, 17 nt, Artificial Sequence
  Synthetic
ggccuggguuguguggg

SEQ ID NO: 9691 - RNA, 17 nt, Artificial Sequence
  Synthetic
ggcccaggugaagcugg

SEQ ID NO: 9692 - RNA, 17 nt, Artificial Sequence
  Synthetic
ggcuccaggaaaggugg

SEQ ID NO: 9693 - RNA, 17 nt, Artificial Sequence
  Synthetic
guggggggcaguggugg

SEQ ID NO: 9694 - RNA, 17 nt, Artificial Sequence
  Synthetic
ggaggagugggagaaug

SEQ ID NO: 9695 - RNA, 17 nt, Artificial Sequence
  Synthetic
ggagcccugcaguccug

SEQ ID NO: 9696 - RNA, 17 nt, Artificial Sequence
  Synthetic
gggcccaggugaagcug

SEQ ID NO: 9697 - RNA, 17 nt, Artificial Sequence
  Synthetic
gccagaggcuggagcug

SEQ ID NO: 9698 - RNA, 17 nt, Artificial Sequence
  Synthetic
gacaggcaaggaggcug

SEQ ID NO: 9699 - RNA, 17 nt, Artificial Sequence
  Synthetic
ggcggggggaggggcug

SEQ ID NO: 9700 - RNA, 17 nt, Artificial Sequence
  Synthetic
ggauauguggggcagug

SEQ ID NO: 9701 - RNA, 17 nt, Artificial Sequence
  Synthetic
ggcucugugugggagug

SEQ ID NO: 9702 - RNA, 17 nt, Artificial Sequence
  Synthetic
ggacaggauggcaggug

SEQ ID NO: 9703 - RNA, 17 nt, Artificial Sequence
  Synthetic
gguggggggcaguggug

SEQ ID NO: 9704 - RNA, 17 nt, Artificial Sequence
  Synthetic
gcagggccuggguugug

SEQ ID NO: 9705 - RNA, 17 nt, Artificial Sequence
  Synthetic
gcuccuggaagcacacu

SEQ ID NO: 9706 - RNA, 17 nt, Artificial Sequence
  Synthetic
ggggcccaggugaagcu

SEQ ID NO: 9707 - RNA, 17 nt, Artificial Sequence
  Synthetic
gaagccacagaccaggu

SEQ ID NO: 9708 - RNA, 17 nt, Artificial Sequence
  Synthetic
gcugagagggccugggu

SEQ ID NO: 9709 - RNA, 17 nt, Artificial Sequence
  Synthetic
gaggagugggagaaugu

SEQ ID NO: 9710 - RNA, 17 nt, Artificial Sequence
  Synthetic
gagggggaggagagguu

SEQ ID NO: 9711 - RNA, 17 nt, Artificial Sequence
  Synthetic
gccuucuguuucucuuu

SEQ ID NO: 9712 - RNA, 20 nt, Artificial Sequence
  Synthetic
gaagggggcagagacagaaa

SEQ ID NO: 9713 - RNA, 20 nt, Artificial Sequence
  Synthetic
ggaagggggcagagacagaa

SEQ ID NO: 9714 - RNA, 20 nt, Artificial Sequence
  Synthetic
gaggaagaagaccaaaggaa

SEQ ID NO: 9715 - RNA, 20 nt, Artificial Sequence
  Synthetic
gagaccuuuucacagagcca

SEQ ID NO: 9716 - RNA, 20 nt, Artificial Sequence
  Synthetic
gcaacucugugaccacagca

SEQ ID NO: 9717 - RNA, 20 nt, Artificial Sequence
  Synthetic
gagugagagggggcaaggca

SEQ ID NO: 9718 - RNA, 20 nt, Artificial Sequence
  Synthetic
ggaaaggaagagggugggca

SEQ ID NO: 9719 - RNA, 20 nt, Artificial Sequence
  Synthetic
gucucugccccaggacugca

SEQ ID NO: 9720 - RNA, 20 nt, Artificial Sequence
  Synthetic
gagacccaaagagaaacaga

SEQ ID NO: 9721 - RNA, 20 nt, Artificial Sequence
  Synthetic
gaaggaaggagggcucccga

SEQ ID NO: 9722 - RNA, 20 nt, Artificial Sequence
  Synthetic
ggaggaagaagaccaaagga

SEQ ID NO: 9723 - RNA, 20 nt, Artificial Sequence
  Synthetic
ggggaaccgggaggacagga

SEQ ID NO: 9724 - RNA, 20 nt, Artificial Sequence
  Synthetic
ggaaucagcaggaaagagga

SEQ ID NO: 9725 - RNA, 20 nt, Artificial Sequence
  Synthetic
gugagcaaggagagagagga

SEQ ID NO: 9726 - RNA, 20 nt, Artificial Sequence
  Synthetic
gcuccaggaaagguggagga

SEQ ID NO: 9727 - RNA, 20 nt, Artificial Sequence
  Synthetic
gaaggacagagagauaggga

SEQ ID NO: 9728 - RNA, 20 nt, Artificial Sequence
  Synthetic
gcagggaaagcaggcacuga

SEQ ID NO: 9729 - RNA, 20 nt, Artificial Sequence
  Synthetic
gggccagaggcuggagcuga

SEQ ID NO: 9730 - RNA, 20 nt, Artificial Sequence
  Synthetic
ggggacaggauggcagguga

SEQ ID NO: 9731 - RNA, 20 nt, Artificial Sequence
  Synthetic
gagagccacccacacaaccc

SEQ ID NO: 9732 - RNA, 20 nt, Artificial Sequence
  Synthetic
gccuccagcuucccacuccc

SEQ ID NO: 9733 - RNA, 20 nt, Artificial Sequence
  Synthetic
gggagugagggaggccuucc

SEQ ID NO: 9734 - RNA, 20 nt, Artificial Sequence
  Synthetic
gggaggggcccaggugaagc

SEQ ID NO: 9735 - RNA, 20 nt, Artificial Sequence
  Synthetic
ggcugaggaggagucagagc

SEQ ID NO: 9736 - RNA, 20 nt, Artificial Sequence
  Synthetic
ggggccaaaagugccggagc

SEQ ID NO: 9737 - RNA, 20 nt, Artificial Sequence
  Synthetic
guuggauuucaggcaugagc

SEQ ID NO: 9738 - RNA, 20 nt, Artificial Sequence
  Synthetic
ggggggagaggaagagaggc

SEQ ID NO: 9739 - RNA, 20 nt, Artificial Sequence
  Synthetic
ggcacugagugaguagaggc

SEQ ID NO: 9740 - RNA, 20 nt, Artificial Sequence
  Synthetic
gcuggcuuguggagggaggc

SEQ ID NO: 9741 - RNA, 20 nt, Artificial Sequence
  Synthetic
ggugaagcugggggcuaggc

SEQ ID NO: 9742 - RNA, 20 nt, Artificial Sequence
  Synthetic
gugaccacauuccugcacuc

SEQ ID NO: 9743 - RNA, 20 nt, Artificial Sequence
  Synthetic
gaggacaggagggcagaaag

SEQ ID NO: 9744 - RNA, 20 nt, Artificial Sequence
  Synthetic
gagggcaacacaaggagaag

SEQ ID NO: 9745 - RNA, 20 nt, Artificial Sequence
  Synthetic
gaaagagggagacaauagag

SEQ ID NO: 9746 - RNA, 20 nt, Artificial Sequence
  Synthetic
guggaggagggagggaggag

SEQ ID NO: 9747 - RNA, 20 nt, Artificial Sequence
  Synthetic
gagagauagggauggaggag

SEQ ID NO: 9748 - RNA, 20 nt, Artificial Sequence
  Synthetic
ggugagcagggcggggggag

SEQ ID NO: 9749 - RNA, 20 nt, Artificial Sequence
  Synthetic
gggcaaggcaagggggggag

SEQ ID NO: 9750 - RNA, 20 nt, Artificial Sequence
  Synthetic
gcagauagagagggagugag

SEQ ID NO: 9751 - RNA, 20 nt, Artificial Sequence
  Synthetic
gggacaggauggcaggugag

SEQ ID NO: 9752 - RNA, 20 nt, Artificial Sequence
  Synthetic
ggaagaagaccaaaggaagg

SEQ ID NO: 9753 - RNA, 20 nt, Artificial Sequence
  Synthetic
ggugagcaaggagagagagg

SEQ ID NO: 9754 - RNA, 20 nt, Artificial Sequence
  Synthetic
gaggcaggauuagagagagg

SEQ ID NO: 9755 - RNA, 20 nt, Artificial Sequence
  Synthetic
ggcuccaggaaagguggagg

SEQ ID NO: 9756 - RNA, 20 nt, Artificial Sequence
  Synthetic
ggcggggggaggggcugagg

SEQ ID NO: 9757 - RNA, 20 nt, Artificial Sequence
  Synthetic
gcugcaccugucaggugagg

SEQ ID NO: 9758 - RNA, 20 nt, Artificial Sequence
  Synthetic
gggggcagagacagaaaggg

SEQ ID NO: 9759 - RNA, 20 nt, Artificial Sequence
  Synthetic
gagagggggcaaggcaaggg

SEQ ID NO: 9760 - RNA, 20 nt, Artificial Sequence
  Synthetic
gaaagguggaggagggaggg

SEQ ID NO: 9761 - RNA, 20 nt, Artificial Sequence
  Synthetic
gucugcuggcuuguggaggg

SEQ ID NO: 9762 - RNA, 20 nt, Artificial Sequence
  Synthetic
gcucugugugggagugaggg

SEQ ID NO: 9763 - RNA, 20 nt, Artificial Sequence
  Synthetic
gcaccugucaggugaggggg

SEQ ID NO: 9764 - RNA, 20 nt, Artificial Sequence
  Synthetic
ggacagagagauagggaugg

SEQ ID NO: 9765 - RNA, 20 nt, Artificial Sequence
  Synthetic
gagugaguagaggcaggugg

SEQ ID NO: 9766 - RNA, 20 nt, Artificial Sequence
  Synthetic
gagggaggagugggagaaug

SEQ ID NO: 9767 - RNA, 20 nt, Artificial Sequence
  Synthetic
gaggggcccaggugaagcug

SEQ ID NO: 9768 - RNA, 20 nt, Artificial Sequence
  Synthetic
gcagacaggcaaggaggcug

SEQ ID NO: 9769 - RNA, 20 nt, Artificial Sequence
  Synthetic
gggggacaggauggcaggug

SEQ ID NO: 9770 - RNA, 20 nt, Artificial Sequence
  Synthetic
gcagguggggggcaguggug

SEQ ID NO: 9771 - RNA, 20 nt, Artificial Sequence
  Synthetic
gucuguggcuuccucucuug

SEQ ID NO: 9772 - RNA, 20 nt, Artificial Sequence
  Synthetic
ggaggggcccaggugaagcu

SEQ ID NO: 9773 - RNA, 20 nt, Artificial Sequence
  Synthetic
gggccaaaagugccggagcu

SEQ ID NO: 9774 - RNA, 20 nt, Artificial Sequence
  Synthetic
gagacagaaagggaggugcu

SEQ ID NO: 9775 - RNA, 20 nt, Artificial Sequence
  Synthetic
gcagagaugacaccuucucu

SEQ ID NO: 9776 - RNA, 20 nt, Artificial Sequence
  Synthetic
gagcuagaggcucagcaagu

SEQ ID NO: 9777 - RNA, 20 nt, Artificial Sequence
  Synthetic
ggcagguggggggcaguggu

SEQ ID NO: 9778 - RNA, 20 nt, Artificial Sequence
  Synthetic
ggugagggggaggagagguu

SEQ ID NO: 9779 - RNA, 17 nt, Artificial Sequence
  Synthetic
agaaucagacccaaaaa

SEQ ID NO: 9780 - RNA, 17 nt, Artificial Sequence
  Synthetic
aaagauugucuuuaaaa

SEQ ID NO: 9781 - RNA, 17 nt, Artificial Sequence
  Synthetic
caggcaaagaagagaaa

SEQ ID NO: 9782 - RNA, 17 nt, Artificial Sequence
  Synthetic
uccuuggcucugugaaa

SEQ ID NO: 9783 - RNA, 17 nt, Artificial Sequence
  Synthetic
cacaagccagcagacaa

SEQ ID NO: 9784 - RNA, 17 nt, Artificial Sequence
  Synthetic
uggaggaagaagaccaa

SEQ ID NO: 9785 - RNA, 17 nt, Artificial Sequence
  Synthetic
uccaggaaggagagcaa

SEQ ID NO: 9786 - RNA, 17 nt, Artificial Sequence
  Synthetic
aauaguuuucauaucaa

SEQ ID NO: 9787 - RNA, 17 nt, Artificial Sequence
  Synthetic
agggggcagagacagaa

SEQ ID NO: 9788 - RNA, 17 nt, Artificial Sequence
  Synthetic
aauuucuccuccuccca

SEQ ID NO: 9789 - RNA, 17 nt, Artificial Sequence
  Synthetic
cuccaggaaggagagca

SEQ ID NO: 9790 - RNA, 17 nt, Artificial Sequence
  Synthetic
uagagugagagggggca

SEQ ID NO: 9791 - RNA, 17 nt, Artificial Sequence
  Synthetic
aaggcggacucugggca

SEQ ID NO: 9792 - RNA, 17 nt, Artificial Sequence
  Synthetic
aaggaagagggugggca

SEQ ID NO: 9793 - RNA, 17 nt, Artificial Sequence
  Synthetic
ucugccccaggacugca

SEQ ID NO: 9794 - RNA, 17 nt, Artificial Sequence
  Synthetic
cuucucucuucucugca

SEQ ID NO: 9795 - RNA, 17 nt, Artificial Sequence
  Synthetic
aaauaguuuucauauca

SEQ ID NO: 9796 - RNA, 17 nt, Artificial Sequence
  Synthetic
acaggagggcagaaaga

SEQ ID NO: 9797 - RNA, 17 nt, Artificial Sequence
  Synthetic
acccaaagagaaacaga

SEQ ID NO: 9798 - RNA, 17 nt, Artificial Sequence
  Synthetic
cagaaggcagauagaga

SEQ ID NO: 9799 - RNA, 17 nt, Artificial Sequence
  Synthetic
agaucugaacaaguaga

SEQ ID NO: 9800 - RNA, 17 nt, Artificial Sequence
  Synthetic
auagagagggacagcga

SEQ ID NO: 9801 - RNA, 17 nt, Artificial Sequence
  Synthetic
aucagcaggaaagagga

SEQ ID NO: 9802 - RNA, 17 nt, Artificial Sequence
  Synthetic
agcaaggagagagagga

SEQ ID NO: 9803 - RNA, 17 nt, Artificial Sequence
  Synthetic
ccaggaaagguggagga

SEQ ID NO: 9804 - RNA, 17 nt, Artificial Sequence
  Synthetic
cugauuuauccuuggga

SEQ ID NO: 9805 - RNA, 17 nt, Artificial Sequence
  Synthetic
uucucugcagggccuga

SEQ ID NO: 9806 - RNA, 17 nt, Artificial Sequence
  Synthetic
ccagaggcuggagcuga

SEQ ID NO: 9807 - RNA, 17 nt, Artificial Sequence
  Synthetic
ugcaauacaauaagaua

SEQ ID NO: 9808 - RNA, 17 nt, Artificial Sequence
  Synthetic
aaugcagcaaaaggaua

SEQ ID NO: 9809 - RNA, 17 nt, Artificial Sequence
  Synthetic
ccucugcuucccugaua

SEQ ID NO: 9810 - RNA, 17 nt, Artificial Sequence
  Synthetic
caaggaggcugggggac

SEQ ID NO: 9811 - RNA, 17 nt, Artificial Sequence
  Synthetic
aaccaggauuccaaacc

SEQ ID NO: 9812 - RNA, 17 nt, Artificial Sequence
  Synthetic
cggggcucaggugcacc

SEQ ID NO: 9813 - RNA, 17 nt, Artificial Sequence
  Synthetic
uagcccccagcuucacc

SEQ ID NO: 9814 - RNA, 17 nt, Artificial Sequence
  Synthetic
cacuguggacacagacc

SEQ ID NO: 9815 - RNA, 17 nt, Artificial Sequence
  Synthetic
agaggaagccacagacc

SEQ ID NO: 9816 - RNA, 17 nt, Artificial Sequence
  Synthetic
aggaaagaggagggacc

SEQ ID NO: 9817 - RNA, 17 nt, Artificial Sequence
  Synthetic
agccacccacacaaccc

SEQ ID NO: 9818 - RNA, 17 nt, Artificial Sequence
  Synthetic
cacgccuagacaggccc

SEQ ID NO: 9819 - RNA, 17 nt, Artificial Sequence
  Synthetic
uccagcuucccacuccc

SEQ ID NO: 9820 - RNA, 17 nt, Artificial Sequence
  Synthetic
ucaccugggccccuccc

SEQ ID NO: 9821 - RNA, 17 nt, Artificial Sequence
  Synthetic
accuggaugugaaagcc

SEQ ID NO: 9822 - RNA, 17 nt, Artificial Sequence
  Synthetic
uuugagaucaaacagcc

SEQ ID NO: 9823 - RNA, 17 nt, Artificial Sequence
  Synthetic
aggagaaggggccagcc

SEQ ID NO: 9824 - RNA, 17 nt, Artificial Sequence
  Synthetic
cccaggcccucucagcc

SEQ ID NO: 9825 - RNA, 17 nt, Artificial Sequence
  Synthetic
cuguuggcugccaggcc

SEQ ID NO: 9826 - RNA, 17 nt, Artificial Sequence
  Synthetic
auuacacauuccuggcc

SEQ ID NO: 9827 - RNA, 17 nt, Artificial Sequence
  Synthetic
aaccugguuuggaaucc

SEQ ID NO: 9828 - RNA, 17 nt, Artificial Sequence
  Synthetic
aggcagcccagaccucc

SEQ ID NO: 9829 - RNA, 17 nt, Artificial Sequence
  Synthetic
cugcccuccuguccucc

SEQ ID NO: 9830 - RNA, 17 nt, Artificial Sequence
  Synthetic
caggacugcagggcucc

SEQ ID NO: 9831 - RNA, 17 nt, Artificial Sequence
  Synthetic
cuggagcccugcagucc

SEQ ID NO: 9832 - RNA, 17 nt, Artificial Sequence
  Synthetic
agugagggaggccuucc

SEQ ID NO: 9833 - RNA, 17 nt, Artificial Sequence
  Synthetic
ccccuugcucuccuucc

SEQ ID NO: 9834 - RNA, 17 nt, Artificial Sequence
  Synthetic
cuuucccugccucuucc

SEQ ID NO: 9835 - RNA, 17 nt, Artificial Sequence
  Synthetic
cccuccuccaccuuucc

SEQ ID NO: 9836 - RNA, 17 nt, Artificial Sequence
  Synthetic
accugggagugggaagc

SEQ ID NO: 9837 - RNA, 17 nt, Artificial Sequence
  Synthetic
ugaggaggagucagagc

SEQ ID NO: 9838 - RNA, 17 nt, Artificial Sequence
  Synthetic
aggucagggccagaggc

SEQ ID NO: 9839 - RNA, 17 nt, Artificial Sequence
  Synthetic
cagacaggcaaggaggc

SEQ ID NO: 9840 - RNA, 17 nt, Artificial Sequence
  Synthetic
cugggggacaggauggc

SEQ ID NO: 9841 - RNA, 17 nt, Artificial Sequence
  Synthetic
cucugccccaggacugc

SEQ ID NO: 9842 - RNA, 17 nt, Artificial Sequence
  Synthetic
ucuucucucuucucugc

SEQ ID NO: 9843 - RNA, 17 nt, Artificial Sequence
  Synthetic
accacauuccugcacuc

SEQ ID NO: 9844 - RNA, 17 nt, Artificial Sequence
  Synthetic
agggcuggaggagacuc

SEQ ID NO: 9845 - RNA, 17 nt, Artificial Sequence
  Synthetic
cccucagcuccagccuc

SEQ ID NO: 9846 - RNA, 17 nt, Artificial Sequence
  Synthetic
ugccucuuccugggcuc

SEQ ID NO: 9847 - RNA, 17 nt, Artificial Sequence
  Synthetic
cagggcuccaggagguc

SEQ ID NO: 9848 - RNA, 17 nt, Artificial Sequence
  Synthetic
ugggccccucccggguc

SEQ ID NO: 9849 - RNA, 17 nt, Artificial Sequence
  Synthetic
uccugcucuccucuuuc

SEQ ID NO: 9850 - RNA, 17 nt, Artificial Sequence
  Synthetic
aggaaucagcaggaaag

SEQ ID NO: 9851 - RNA, 17 nt, Artificial Sequence
  Synthetic
ccaggaaggagagcaag

SEQ ID NO: 9852 - RNA, 17 nt, Artificial Sequence
  Synthetic
agagggggcaaggcaag

SEQ ID NO: 9853 - RNA, 17 nt, Artificial Sequence
  Synthetic
ugcagagaagagagaag

SEQ ID NO: 9854 - RNA, 17 nt, Artificial Sequence
  Synthetic
aagaagaccaaaggaag

SEQ ID NO: 9855 - RNA, 17 nt, Artificial Sequence
  Synthetic
aggcagguggggggcag

SEQ ID NO: 9856 - RNA, 17 nt, Artificial Sequence
  Synthetic
agagggagacaauagag

SEQ ID NO: 9857 - RNA, 17 nt, Artificial Sequence
  Synthetic
acagaaggcagauagag

SEQ ID NO: 9858 - RNA, 17 nt, Artificial Sequence
  Synthetic
agcaaaaggauaaggag

SEQ ID NO: 9859 - RNA, 17 nt, Artificial Sequence
  Synthetic
ucagggaagcagaggag

SEQ ID NO: 9860 - RNA, 17 nt, Artificial Sequence
  Synthetic
caggugagggggaggag

SEQ ID NO: 9861 - RNA, 17 nt, Artificial Sequence
  Synthetic
agauagggauggaggag

SEQ ID NO: 9862 - RNA, 17 nt, Artificial Sequence
  Synthetic
acaggauggcaggugag

SEQ ID NO: 9863 - RNA, 17 nt, Artificial Sequence
  Synthetic
ugcaccugucaggugag

SEQ ID NO: 9864 - RNA, 17 nt, Artificial Sequence
  Synthetic
aagcugggggcuaggcg

SEQ ID NO: 9865 - RNA, 17 nt, Artificial Sequence
  Synthetic
caggaaggagagcaagg

SEQ ID NO: 9866 - RNA, 17 nt, Artificial Sequence
  Synthetic
uacuggaccugagaagg

SEQ ID NO: 9867 - RNA, 17 nt, Artificial Sequence
  Synthetic
agaagaccaaaggaagg

SEQ ID NO: 9868 - RNA, 17 nt, Artificial Sequence
  Synthetic
aaagaggagggaccagg

SEQ ID NO: 9869 - RNA, 17 nt, Artificial Sequence
  Synthetic
aaucagcaggaaagagg

SEQ ID NO: 9870 - RNA, 17 nt, Artificial Sequence
  Synthetic
agacaggcccugggagg

SEQ ID NO: 9871 - RNA, 17 nt, Artificial Sequence
  Synthetic
agagauagggauggagg

SEQ ID NO: 9872 - RNA, 17 nt, Artificial Sequence
  Synthetic
uccaggaaagguggagg

SEQ ID NO: 9873 - RNA, 17 nt, Artificial Sequence
  Synthetic
cuggacaagguuggagg

SEQ ID NO: 9874 - RNA, 17 nt, Artificial Sequence
  Synthetic
cugagcccacagcuagg

SEQ ID NO: 9875 - RNA, 17 nt, Artificial Sequence
  Synthetic
ugaagcugggggcuagg

SEQ ID NO: 9876 - RNA, 17 nt, Artificial Sequence
  Synthetic
aggaaggagagcaaggg

SEQ ID NO: 9877 - RNA, 17 nt, Artificial Sequence
  Synthetic
agggggcaaggcaaggg

SEQ ID NO: 9878 - RNA, 17 nt, Artificial Sequence
  Synthetic
aaauagaaaaggcaggg

SEQ ID NO: 9879 - RNA, 17 nt, Artificial Sequence
  Synthetic
agguggaggagggaggg

SEQ ID NO: 9880 - RNA, 17 nt, Artificial Sequence
  Synthetic
ugcuggcuuguggaggg

SEQ ID NO: 9881 - RNA, 17 nt, Artificial Sequence
  Synthetic
cugugugggagugaggg

SEQ ID NO: 9882 - RNA, 17 nt, Artificial Sequence
  Synthetic
ccugucaggugaggggg

SEQ ID NO: 9883 - RNA, 17 nt, Artificial Sequence
  Synthetic
cagagagauagggaugg

SEQ ID NO: 9884 - RNA, 17 nt, Artificial Sequence
  Synthetic
ugggagugggaagcugg

SEQ ID NO: 9885 - RNA, 17 nt, Artificial Sequence
  Synthetic
acaggcaaggaggcugg

SEQ ID NO: 9886 - RNA, 17 nt, Artificial Sequence
  Synthetic
cagguggggggcagugg

SEQ ID NO: 9887 - RNA, 17 nt, Artificial Sequence
  Synthetic
ugaguagaggcaggugg

SEQ ID NO: 9888 - RNA, 17 nt, Artificial Sequence
  Synthetic
cccagagugcaggaaug

SEQ ID NO: 9889 - RNA, 17 nt, Artificial Sequence
  Synthetic
aaggugcagggaggaug

SEQ ID NO: 9890 - RNA, 17 nt, Artificial Sequence
  Synthetic
uggagccagcagaccug

SEQ ID NO: 9891 - RNA, 17 nt, Artificial Sequence
  Synthetic
agggugaggcugaccug

SEQ ID NO: 9892 - RNA, 17 nt, Artificial Sequence
  Synthetic
cuucucugcagggccug

SEQ ID NO: 9893 - RNA, 17 nt, Artificial Sequence
  Synthetic
cucugggcugccuccug

SEQ ID NO: 9894 - RNA, 17 nt, Artificial Sequence
  Synthetic
auucuccuccuccucug

SEQ ID NO: 9895 - RNA, 17 nt, Artificial Sequence
  Synthetic
ugcagggccugagggug

SEQ ID NO: 9896 - RNA, 17 nt, Artificial Sequence
  Synthetic
cugagagggccugggug

SEQ ID NO: 9897 - RNA, 17 nt, Artificial Sequence
  Synthetic
cugggcugccuccugug

SEQ ID NO: 9898 - RNA, 17 nt, Artificial Sequence
  Synthetic
cuuugucugcuggcuug

SEQ ID NO: 9899 - RNA, 17 nt, Artificial Sequence
  Synthetic
uucccacucccagguug

SEQ ID NO: 9900 - RNA, 17 nt, Artificial Sequence
  Synthetic
agguuagaaaacaaaau

SEQ ID NO: 9901 - RNA, 17 nt, Artificial Sequence
  Synthetic
aagggcuggaggagacu

SEQ ID NO: 9902 - RNA, 17 nt, Artificial Sequence
  Synthetic
uccugcagugagccccu

SEQ ID NO: 9903 - RNA, 17 nt, Artificial Sequence
  Synthetic
cccaguucaccugcccu

SEQ ID NO: 9904 - RNA, 17 nt, Artificial Sequence
  Synthetic
ccaggcugagagggccu

SEQ ID NO: 9905 - RNA, 17 nt, Artificial Sequence
  Synthetic
uggagcccugcaguccu

SEQ ID NO: 9906 - RNA, 17 nt, Artificial Sequence
  Synthetic
aaagaacagaauguccu

SEQ ID NO: 9907 - RNA, 17 nt, Artificial Sequence
  Synthetic
uuucccugccucuuccu

SEQ ID NO: 9908 - RNA, 17 nt, Artificial Sequence
  Synthetic
agacaggcaaggaggcu

SEQ ID NO: 9909 - RNA, 17 nt, Artificial Sequence
  Synthetic
aggugaagcugggggcu

SEQ ID NO: 9910 - RNA, 17 nt, Artificial Sequence
  Synthetic
acagaaagggaggugcu

SEQ ID NO: 9911 - RNA, 17 nt, Artificial Sequence
  Synthetic
ucugcucucugggugcu

SEQ ID NO: 9912 - RNA, 17 nt, Artificial Sequence
  Synthetic
aauucuccuccuccucu

SEQ ID NO: 9913 - RNA, 17 nt, Artificial Sequence
  Synthetic
ccucccagggccugucu

SEQ ID NO: 9914 - RNA, 17 nt, Artificial Sequence
  Synthetic
aggagggagggaggagu

SEQ ID NO: 9915 - RNA, 17 nt, Artificial Sequence
  Synthetic
cuggaaaggaagagggu

SEQ ID NO: 9916 - RNA, 17 nt, Artificial Sequence
  Synthetic
agguggggggcaguggu

SEQ ID NO: 9917 - RNA, 17 nt, Artificial Sequence
  Synthetic
cagggccuggguugugu

SEQ ID NO: 9918 - RNA, 17 nt, Artificial Sequence
  Synthetic
aaaacugauuuauccuu

SEQ ID NO: 9919 - RNA, 17 nt, Artificial Sequence
  Synthetic
ucucugcccccuuccuu

SEQ ID NO: 9920 - RNA, 17 nt, Artificial Sequence
  Synthetic
ugccuucuguuucucuu

SEQ ID NO: 9921 - RNA, 17 nt, Artificial Sequence
  Synthetic
aguuuggaaagagauuu

SEQ ID NO: 9922 - RNA, 20 nt, Artificial Sequence
  Synthetic
cagagaaucagacccaaaaa

SEQ ID NO: 9923 - RNA, 20 nt, Artificial Sequence
  Synthetic
uuaaaagauugucuuuaaaa

SEQ ID NO: 9924 - RNA, 20 nt, Artificial Sequence
  Synthetic
uccaaacuuaaugcagcaaa

SEQ ID NO: 9925 - RNA, 20 nt, Artificial Sequence
  Synthetic
uagcaggcaaagaagagaaa

SEQ ID NO: 9926 - RNA, 20 nt, Artificial Sequence
  Synthetic
agucugucucaggaaguaaa

SEQ ID NO: 9927 - RNA, 20 nt, Artificial Sequence
  Synthetic
cuccacaagccagcagacaa

SEQ ID NO: 9928 - RNA, 20 nt, Artificial Sequence
  Synthetic
agugagagggggcaaggcaa

SEQ ID NO: 9929 - RNA, 20 nt, Artificial Sequence
  Synthetic
acgaauuucuccuccuccca

SEQ ID NO: 9930 - RNA, 20 nt, Artificial Sequence
  Synthetic
accacuagcuuaaggcagca

SEQ ID NO: 9931 - RNA, 20 nt, Artificial Sequence
  Synthetic
ccucuucucucuucucugca

SEQ ID NO: 9932 - RNA, 20 nt, Artificial Sequence
  Synthetic
uacuuccugagacagacuca

SEQ ID NO: 9933 - RNA, 20 nt, Artificial Sequence
  Synthetic
caggacacagcucgagguca

SEQ ID NO: 9934 - RNA, 20 nt, Artificial Sequence
  Synthetic
aggacaggagggcagaaaga

SEQ ID NO: 9935 - RNA, 20 nt, Artificial Sequence
  Synthetic
ucaggaagccuucccagaga

SEQ ID NO: 9936 - RNA, 20 nt, Artificial Sequence
  Synthetic
aaagagggagacaauagaga

SEQ ID NO: 9937 - RNA, 20 nt, Artificial Sequence
  Synthetic
aaacagaaggcagauagaga

SEQ ID NO: 9938 - RNA, 20 nt, Artificial Sequence
  Synthetic
aggagggcaacacaaggaga

SEQ ID NO: 9939 - RNA, 20 nt, Artificial Sequence
  Synthetic
aggggccagccaggcugaga

SEQ ID NO: 9940 - RNA, 20 nt, Artificial Sequence
  Synthetic
caguggugggggcaaauaga

SEQ ID NO: 9941 - RNA, 20 nt, Artificial Sequence
  Synthetic
caaagaucugaacaaguaga

SEQ ID NO: 9942 - RNA, 20 nt, Artificial Sequence
  Synthetic
aaggaggcugggggacagga

SEQ ID NO: 9943 - RNA, 20 nt, Artificial Sequence
  Synthetic
agagagauagggauggagga

SEQ ID NO: 9944 - RNA, 20 nt, Artificial Sequence
  Synthetic
caggaaagguggaggaggga

SEQ ID NO: 9945 - RNA, 20 nt, Artificial Sequence
  Synthetic
aggugagcagggcgggggga

SEQ ID NO: 9946 - RNA, 20 nt, Artificial Sequence
  Synthetic
cagcgaaggacagagagaua

SEQ ID NO: 9947 - RNA, 20 nt, Artificial Sequence
  Synthetic
cuuaaugcagcaaaaggaua

SEQ ID NO: 9948 - RNA, 20 nt, Artificial Sequence
  Synthetic
ccaagggcuaggggagccua

SEQ ID NO: 9949 - RNA, 20 nt, Artificial Sequence
  Synthetic
aaaaagaacagaauguccua

SEQ ID NO: 9950 - RNA, 20 nt, Artificial Sequence
  Synthetic
agagggccuggguggggaac

SEQ ID NO: 9951 - RNA, 20 nt, Artificial Sequence
  Synthetic
aggcaaggaggcugggggac

SEQ ID NO: 9952 - RNA, 20 nt, Artificial Sequence
  Synthetic
ucuccucccccucaccugac

SEQ ID NO: 9953 - RNA, 20 nt, Artificial Sequence
  Synthetic
aagagaggaagccacagacc

SEQ ID NO: 9954 - RNA, 20 nt, Artificial Sequence
  Synthetic
caauaaggugcucagcaccc

SEQ ID NO: 9955 - RNA, 20 nt, Artificial Sequence
  Synthetic
uccagacccgggaggggccc

SEQ ID NO: 9956 - RNA, 20 nt, Artificial Sequence
  Synthetic
ugcaccuggaugugaaagcc

SEQ ID NO: 9957 - RNA, 20 nt, Artificial Sequence
  Synthetic
ccacccaggcccucucagcc

SEQ ID NO: 9958 - RNA, 20 nt, Artificial Sequence
  Synthetic
agcccgcccgcuggccggcc

SEQ ID NO: 9959 - RNA, 20 nt, Artificial Sequence
  Synthetic
ccagccaggcugagagggcc

SEQ ID NO: 9960 - RNA, 20 nt, Artificial Sequence
  Synthetic
uccuuuggucuucuuccucc

SEQ ID NO: 9961 - RNA, 20 nt, Artificial Sequence
  Synthetic
ccccaggacugcagggcucc

SEQ ID NO: 9962 - RNA, 20 nt, Artificial Sequence
  Synthetic
ccugccucuuccugggcucc

SEQ ID NO: 9963 - RNA, 20 nt, Artificial Sequence
  Synthetic
cuccuggagcccugcagucc

SEQ ID NO: 9964 - RNA, 20 nt, Artificial Sequence
  Synthetic
cugcuuucccugccucuucc

SEQ ID NO: 9965 - RNA, 20 nt, Artificial Sequence
  Synthetic
ccucccuccuccaccuuucc

SEQ ID NO: 9966 - RNA, 20 nt, Artificial Sequence
  Synthetic
caggaagaggcagggaaagc

SEQ ID NO: 9967 - RNA, 20 nt, Artificial Sequence
  Synthetic
cgacuucuuaaagugaaagc

SEQ ID NO: 9968 - RNA, 20 nt, Artificial Sequence
  Synthetic
caggccagaaagaggagagc

SEQ ID NO: 9969 - RNA, 20 nt, Artificial Sequence
  Synthetic
agggaggauguggccagcgc

SEQ ID NO: 9970 - RNA, 20 nt, Artificial Sequence
  Synthetic
agcuggcaaauagaaaaggc

SEQ ID NO: 9971 - RNA, 20 nt, Artificial Sequence
  Synthetic
cccggagcccaggaagaggc

SEQ ID NO: 9972 - RNA, 20 nt, Artificial Sequence
  Synthetic
auagagagggagugagaggc

SEQ ID NO: 9973 - RNA, 20 nt, Artificial Sequence
  Synthetic
caggauuagagagaggaggc

SEQ ID NO: 9974 - RNA, 20 nt, Artificial Sequence
  Synthetic
aggcugggggacaggauggc

SEQ ID NO: 9975 - RNA, 20 nt, Artificial Sequence
  Synthetic
ccaggcccucucagccuggc

SEQ ID NO: 9976 - RNA, 20 nt, Artificial Sequence
  Synthetic
uggggagcccgcccgcuggc

SEQ ID NO: 9977 - RNA, 20 nt, Artificial Sequence
  Synthetic
ugucucugccccaggacugc

SEQ ID NO: 9978 - RNA, 20 nt, Artificial Sequence
  Synthetic
accucuucucucuucucugc

SEQ ID NO: 9979 - RNA, 20 nt, Artificial Sequence
  Synthetic
caggaggcagcccagagugc

SEQ ID NO: 9980 - RNA, 20 nt, Artificial Sequence
  Synthetic
agacagacucccuuuggugc

SEQ ID NO: 9981 - RNA, 20 nt, Artificial Sequence
  Synthetic
cucccaguucaccugcccuc

SEQ ID NO: 9982 - RNA, 20 nt, Artificial Sequence
  Synthetic
aggcccucagcuccagccuc

SEQ ID NO: 9983 - RNA, 20 nt, Artificial Sequence
  Synthetic
ucagaauucuccuccuccuc

SEQ ID NO: 9984 - RNA, 20 nt, Artificial Sequence
  Synthetic
cccugccucuuccugggcuc

SEQ ID NO: 9985 - RNA, 20 nt, Artificial Sequence
  Synthetic
cugcagggcuccaggagguc

SEQ ID NO: 9986 - RNA, 20 nt, Artificial Sequence
  Synthetic
accugggccccucccggguc

SEQ ID NO: 9987 - RNA, 20 nt, Artificial Sequence
  Synthetic
cucuccugcucuccucuuuc

SEQ ID NO: 9988 - RNA, 20 nt, Artificial Sequence
  Synthetic
agaggaggcaggccagaaag

SEQ ID NO: 9989 - RNA, 20 nt, Artificial Sequence
  Synthetic
ucuccaggaaggagagcaag

SEQ ID NO: 9990 - RNA, 20 nt, Artificial Sequence
  Synthetic
cccugcagagaagagagaag

SEQ ID NO: 9991 - RNA, 20 nt, Artificial Sequence
  Synthetic
aggaagaagaccaaaggaag

SEQ ID NO: 9992 - RNA, 20 nt, Artificial Sequence
  Synthetic
uagaggcagguggggggcag

SEQ ID NO: 9993 - RNA, 20 nt, Artificial Sequence
  Synthetic
cccucaccugacaggugcag

SEQ ID NO: 9994 - RNA, 20 nt, Artificial Sequence
  Synthetic
caagggggggagaggaagag

SEQ ID NO: 9995 - RNA, 20 nt, Artificial Sequence
  Synthetic
aguggugagcaaggagagag

SEQ ID NO: 9996 - RNA, 20 nt, Artificial Sequence
  Synthetic
agagaggcaggauuagagag

SEQ ID NO: 9997 - RNA, 20 nt, Artificial Sequence
  Synthetic
cuaucagggaagcagaggag

SEQ ID NO: 9998 - RNA, 20 nt, Artificial Sequence
  Synthetic
ugucaggugagggggaggag

SEQ ID NO: 9999 - RNA, 20 nt, Artificial Sequence
  Synthetic
ucugcuggcuccaggaaagg

SEQ ID NO: 10000 - RNA, 20 nt, Artificial Sequence
  Synthetic
cuccaggaaggagagcaagg

SEQ ID NO: 10001 - RNA, 20 nt, Artificial Sequence
  Synthetic
ugagagggggcaaggcaagg

SEQ ID NO: 10002 - RNA, 20 nt, Artificial Sequence
  Synthetic
aggaaagaggagggaccagg

SEQ ID NO: 10003 - RNA, 20 nt, Artificial Sequence
  Synthetic
caggacugcagggcuccagg

SEQ ID NO: 10004 - RNA, 20 nt, Artificial Sequence
  Synthetic
aggaaucagcaggaaagagg

SEQ ID NO: 10005 - RNA, 20 nt, Artificial Sequence
  Synthetic
aaagaggagggaccaggagg

SEQ ID NO: 10006 - RNA, 20 nt, Artificial Sequence
  Synthetic
ccuagacaggcccugggagg

SEQ ID NO: 10007 - RNA, 20 nt, Artificial Sequence
  Synthetic
cagagagauagggauggagg

SEQ ID NO: 10008 - RNA, 20 nt, Artificial Sequence
  Synthetic
uccaggaaggagagcaaggg

SEQ ID NO: 10009 - RNA, 20 nt, Artificial Sequence
  Synthetic
ucaauuaaaggugagcaggg

SEQ ID NO: 10010 - RNA, 20 nt, Artificial Sequence
  Synthetic
agcgcuggaaaggaagaggg

SEQ ID NO: 10011 - RNA, 20 nt, Artificial Sequence
  Synthetic
ccaggaaagguggaggaggg

SEQ ID NO: 10012 - RNA, 20 nt, Artificial Sequence
  Synthetic
agagggggcaaggcaagggg

SEQ ID NO: 10013 - RNA, 20 nt, Artificial Sequence
  Synthetic
aaggugagcagggcgggggg

SEQ ID NO: 10014 - RNA, 20 nt, Artificial Sequence
  Synthetic
ccaggcugagagggccuggg

SEQ ID NO: 10015 - RNA, 20 nt, Artificial Sequence
  Synthetic
agugaguagaggcagguggg

SEQ ID NO: 10016 - RNA, 20 nt, Artificial Sequence
  Synthetic
cagggccuggguuguguggg

SEQ ID NO: 10017 - RNA, 20 nt, Artificial Sequence
  Synthetic
accugggagugggaagcugg

SEQ ID NO: 10018 - RNA, 20 nt, Artificial Sequence
  Synthetic
aggggcccaggugaagcugg

SEQ ID NO: 10019 - RNA, 20 nt, Artificial Sequence
  Synthetic
cagacaggcaaggaggcugg

SEQ ID NO: 10020 - RNA, 20 nt, Artificial Sequence
  Synthetic
aggcagguggggggcagugg

SEQ ID NO: 10021 - RNA, 20 nt, Artificial Sequence
  Synthetic
cagguggggggcaguggugg

SEQ ID NO: 10022 - RNA, 20 nt, Artificial Sequence
  Synthetic
cagcccagagugcaggaaug

SEQ ID NO: 10023 - RNA, 20 nt, Artificial Sequence
  Synthetic
ccuggagcccugcaguccug

SEQ ID NO: 10024 - RNA, 20 nt, Artificial Sequence
  Synthetic
agggccagaggcuggagcug

SEQ ID NO: 10025 - RNA, 20 nt, Artificial Sequence
  Synthetic
cagggcggggggaggggcug

SEQ ID NO: 10026 - RNA, 20 nt, Artificial Sequence
  Synthetic
aggcugagagggccugggug

SEQ ID NO: 10027 - RNA, 20 nt, Artificial Sequence
  Synthetic
agcuucccacucccagguug

SEQ ID NO: 10028 - RNA, 20 nt, Artificial Sequence
  Synthetic
acuuccugagacagacucau

SEQ ID NO: 10029 - RNA, 20 nt, Artificial Sequence
  Synthetic
cagccaggcugagagggccu

SEQ ID NO: 10030 - RNA, 20 nt, Artificial Sequence
  Synthetic
ucagaaaacugauuuauccu

SEQ ID NO: 10031 - RNA, 20 nt, Artificial Sequence
  Synthetic
aaaaaagaacagaauguccu

SEQ ID NO: 10032 - RNA, 20 nt, Artificial Sequence
  Synthetic
ugcuuucccugccucuuccu

SEQ ID NO: 10033 - RNA, 20 nt, Artificial Sequence
  Synthetic
cccaggugaagcugggggcu

SEQ ID NO: 10034 - RNA, 20 nt, Artificial Sequence
  Synthetic
cagaauucuccuccuccucu

SEQ ID NO: 10035 - RNA, 20 nt, Artificial Sequence
  Synthetic
ccuccucccagggccugucu

SEQ ID NO: 10036 - RNA, 20 nt, Artificial Sequence
  Synthetic
uggaggagggagggaggagu

SEQ ID NO: 10037 - RNA, 20 nt, Artificial Sequence
  Synthetic
caggcugagagggccugggu

SEQ ID NO: 10038 - RNA, 20 nt, Artificial Sequence
  Synthetic
cagaaaacugauuuauccuu

SEQ ID NO: 10039 - RNA, 20 nt, Artificial Sequence
  Synthetic
cugucucugcccccuuccuu

SEQ ID NO: 10040 - RNA, 20 nt, Artificial Sequence
  Synthetic
aucugccuucuguuucucuu

SEQ ID NO: 10041 - RNA, 20 nt, Artificial Sequence
  Synthetic
ucugccuucuguuucucuuu

SEQ ID NO: 10042 - RNA, 17 nt, Artificial Sequence
  Synthetic
gaaaauaaaagcaaaaa

SEQ ID NO: 10043 - RNA, 17 nt, Artificial Sequence
  Synthetic
aaagaucaucuuuaaaa

SEQ ID NO: 10044 - RNA, 17 nt, Artificial Sequence
  Synthetic
uccuuucccuccccaaa

SEQ ID NO: 10045 - RNA, 17 nt, Artificial Sequence
  Synthetic
gucugggcugagccaaa

SEQ ID NO: 10046 - RNA, 17 nt, Artificial Sequence
  Synthetic
uuccuuucccuccccaa

SEQ ID NO: 10047 - RNA, 17 nt, Artificial Sequence
  Synthetic
ggucugggcugagccaa

SEQ ID NO: 10048 - RNA, 17 nt, Artificial Sequence
  Synthetic
uuggggagggaaaggaa

SEQ ID NO: 10049 - RNA, 17 nt, Artificial Sequence
  Synthetic
gcgcaggcaccagggaa

SEQ ID NO: 10050 - RNA, 17 nt, Artificial Sequence
  Synthetic
ccccuuuggggagggaa

SEQ ID NO: 10051 - RNA, 17 nt, Artificial Sequence
  Synthetic
ggugccugcgccuggaa

SEQ ID NO: 10052 - RNA, 17 nt, Artificial Sequence
  Synthetic
uacauguaaguuuauaa

SEQ ID NO: 10053 - RNA, 17 nt, Artificial Sequence
  Synthetic
gaaaggaaggggacuaa

SEQ ID NO: 10054 - RNA, 17 nt, Artificial Sequence
  Synthetic
gagcucuaccugggaca

SEQ ID NO: 10055 - RNA, 17 nt, Artificial Sequence
  Synthetic
uccaggcgcaggcacca

SEQ ID NO: 10056 - RNA, 17 nt, Artificial Sequence
  Synthetic
ccuggaaggguggucca

SEQ ID NO: 10057 - RNA, 17 nt, Artificial Sequence
  Synthetic
gaaacauaccuauagca

SEQ ID NO: 10058 - RNA, 17 nt, Artificial Sequence
  Synthetic
cccggcaggacguggca

SEQ ID NO: 10059 - RNA, 17 nt, Artificial Sequence
  Synthetic
uuuggggagggaaagga

SEQ ID NO: 10060 - RNA, 17 nt, Artificial Sequence
  Synthetic
ggcgcaggcaccaggga

SEQ ID NO: 10061 - RNA, 17 nt, Artificial Sequence
  Synthetic
uggcuccccuuugggga

SEQ ID NO: 10062 - RNA, 17 nt, Artificial Sequence
  Synthetic
uggugccugcgccugga

SEQ ID NO: 10063 - RNA, 17 nt, Artificial Sequence
  Synthetic
cagagccucagaccuga

SEQ ID NO: 10064 - RNA, 17 nt, Artificial Sequence
  Synthetic
ggaaaggaaggggacua

SEQ ID NO: 10065 - RNA, 17 nt, Artificial Sequence
  Synthetic
ccacguccugccgggua

SEQ ID NO: 10066 - RNA, 17 nt, Artificial Sequence
  Synthetic
gacagauauacaaauua

SEQ ID NO: 10067 - RNA, 17 nt, Artificial Sequence
  Synthetic
cuggagcgggcuagaac

SEQ ID NO: 10068 - RNA, 17 nt, Artificial Sequence
  Synthetic
ggugcugaggugcucac

SEQ ID NO: 10069 - RNA, 17 nt, Artificial Sequence
  Synthetic
uuauuuaucuuagagac

SEQ ID NO: 10070 - RNA, 17 nt, Artificial Sequence
  Synthetic
ugagcucuaccugggac

SEQ ID NO: 10071 - RNA, 17 nt, Artificial Sequence
  Synthetic
uuccaggcgcaggcacc

SEQ ID NO: 10072 - RNA, 17 nt, Artificial Sequence
  Synthetic
uuggcucagcccagacc

SEQ ID NO: 10073 - RNA, 17 nt, Artificial Sequence
  Synthetic
aauagaaaucugagacc

SEQ ID NO: 10074 - RNA, 17 nt, Artificial Sequence
  Synthetic
cugcagcauucuagacc

SEQ ID NO: 10075 - RNA, 17 nt, Artificial Sequence
  Synthetic
auugccacucccauacc

SEQ ID NO: 10076 - RNA, 17 nt, Artificial Sequence
  Synthetic
cagcagugagcucuacc

SEQ ID NO: 10077 - RNA, 17 nt, Artificial Sequence
  Synthetic
ugagcaccucagcaccc

SEQ ID NO: 10078 - RNA, 17 nt, Artificial Sequence
  Synthetic
acugacaccccuguccc

SEQ ID NO: 10079 - RNA, 17 nt, Artificial Sequence
  Synthetic
ucccuggugccugcgcc

SEQ ID NO: 10080 - RNA, 17 nt, Artificial Sequence
  Synthetic
cccugccacguccugcc

SEQ ID NO: 10081 - RNA, 17 nt, Artificial Sequence
  Synthetic
cuguucuagcccgcucc

SEQ ID NO: 10082 - RNA, 17 nt, Artificial Sequence
  Synthetic
acuucugaccaaagucc

SEQ ID NO: 10083 - RNA, 17 nt, Artificial Sequence
  Synthetic
gccuggaaggguggucc

SEQ ID NO: 10084 - RNA, 17 nt, Artificial Sequence
  Synthetic
cccuggaccacccuucc

SEQ ID NO: 10085 - RNA, 17 nt, Artificial Sequence
  Synthetic
cauucuagaccuggagc

SEQ ID NO: 10086 - RNA, 17 nt, Artificial Sequence
  Synthetic
accacccuuccaggcgc

SEQ ID NO: 10087 - RNA, 17 nt, Artificial Sequence
  Synthetic
ugcacuauccucuaggc

SEQ ID NO: 10088 - RNA, 17 nt, Artificial Sequence
  Synthetic
ccacucccauacccggc

SEQ ID NO: 10089 - RNA, 17 nt, Artificial Sequence
  Synthetic
ugaggugcucacugggc

SEQ ID NO: 10090 - RNA, 17 nt, Artificial Sequence
  Synthetic
acccggcaggacguggc

SEQ ID NO: 10091 - RNA, 17 nt, Artificial Sequence
  Synthetic
cagguagagcucacugc

SEQ ID NO: 10092 - RNA, 17 nt, Artificial Sequence
  Synthetic
acccugccacguccugc

SEQ ID NO: 10093 - RNA, 17 nt, Artificial Sequence
  Synthetic
ugucaguucccacccuc

SEQ ID NO: 10094 - RNA, 17 nt, Artificial Sequence
  Synthetic
ccuuucccuccccaaag

SEQ ID NO: 10095 - RNA, 17 nt, Artificial Sequence
  Synthetic
uggggagggaaaggaag

SEQ ID NO: 10096 - RNA, 17 nt, Artificial Sequence
  Synthetic
cgcaggcaccagggaag

SEQ ID NO: 10097 - RNA, 17 nt, Artificial Sequence
  Synthetic
agcucuaccugggacag

SEQ ID NO: 10098 - RNA, 17 nt, Artificial Sequence
  Synthetic
caccagggaaggggcag

SEQ ID NO: 10099 - RNA, 17 nt, Artificial Sequence
  Synthetic
ccugccggguaugggag

SEQ ID NO: 10100 - RNA, 17 nt, Artificial Sequence
  Synthetic
gcauucuagaccuggag

SEQ ID NO: 10101 - RNA, 17 nt, Artificial Sequence
  Synthetic
gcuguacuccagccuag

SEQ ID NO: 10102 - RNA, 17 nt, Artificial Sequence
  Synthetic
ccauacccggcaggacg

SEQ ID NO: 10103 - RNA, 17 nt, Artificial Sequence
  Synthetic
ugggcugagccaaaggg

SEQ ID NO: 10104 - RNA, 17 nt, Artificial Sequence
  Synthetic
gccugcgccuggaaggg

SEQ ID NO: 10105 - RNA, 17 nt, Artificial Sequence
  Synthetic
agccucagaccugaggg

SEQ ID NO: 10106 - RNA, 17 nt, Artificial Sequence
  Synthetic
guggcuccccuuugggg

SEQ ID NO: 10107 - RNA, 17 nt, Artificial Sequence
  Synthetic
agauauacaaauuaugg

SEQ ID NO: 10108 - RNA, 17 nt, Artificial Sequence
  Synthetic
gcagagccucagaccug

SEQ ID NO: 10109 - RNA, 17 nt, Artificial Sequence
  Synthetic
ggugguccagggugcug

SEQ ID NO: 10110 - RNA, 17 nt, Artificial Sequence
  Synthetic
ucccacccucaggucug

SEQ ID NO: 10111 - RNA, 17 nt, Artificial Sequence
  Synthetic
acaggcuugguguugug

SEQ ID NO: 10112 - RNA, 17 nt, Artificial Sequence
  Synthetic
augguggcuccccuuug

SEQ ID NO: 10113 - RNA, 17 nt, Artificial Sequence
  Synthetic
gacagagaccaugcuau

SEQ ID NO: 10114 - RNA, 17 nt, Artificial Sequence
  Synthetic
cacguccugccggguau

SEQ ID NO: 10115 - RNA, 17 nt, Artificial Sequence
  Synthetic
uagaaugcugcagcacu

SEQ ID NO: 10116 - RNA, 17 nt, Artificial Sequence
  Synthetic
gugcugaggugcucacu

SEQ ID NO: 10117 - RNA, 17 nt, Artificial Sequence
  Synthetic
agcagugagcucuaccu

SEQ ID NO: 10118 - RNA, 17 nt, Artificial Sequence
  Synthetic
gcgggcuagaacaggcu

SEQ ID NO: 10119 - RNA, 17 nt, Artificial Sequence
  Synthetic
aucaugcacuauccucu

SEQ ID NO: 10120 - RNA, 17 nt, Artificial Sequence
  Synthetic
auugcaaugccuggucu

SEQ ID NO: 10121 - RNA, 17 nt, Artificial Sequence
  Synthetic
gccucagaccugagggu

SEQ ID NO: 10122 - RNA, 17 nt, Artificial Sequence
  Synthetic
aucugagaccuggacuu

SEQ ID NO: 10123 - RNA, 17 nt, Artificial Sequence
  Synthetic
gcagggucaccacccuu

SEQ ID NO: 10124 - RNA, 17 nt, Artificial Sequence
  Synthetic
uuaugguggcuccccuu

SEQ ID NO: 10125 - RNA, 17 nt, Artificial Sequence
  Synthetic
uaugguggcuccccuuu

SEQ ID NO: 10126 - RNA, 20 nt, Artificial Sequence
  Synthetic
uaagaaaauaaaagcaaaaa

SEQ ID NO: 10127 - RNA, 20 nt, Artificial Sequence
  Synthetic
uuaaaagaucaucuuuaaaa

SEQ ID NO: 10128 - RNA, 20 nt, Artificial Sequence
  Synthetic
ccuuccuuucccuccccaaa

SEQ ID NO: 10129 - RNA, 20 nt, Artificial Sequence
  Synthetic
cuggucugggcugagccaaa

SEQ ID NO: 10130 - RNA, 20 nt, Artificial Sequence
  Synthetic
cccuuccuuucccuccccaa

SEQ ID NO: 10131 - RNA, 20 nt, Artificial Sequence
  Synthetic
ccuggucugggcugagccaa

SEQ ID NO: 10132 - RNA, 20 nt, Artificial Sequence
  Synthetic
ccuuuggggagggaaaggaa

SEQ ID NO: 10133 - RNA, 20 nt, Artificial Sequence
  Synthetic
caggcgcaggcaccagggaa

SEQ ID NO: 10134 - RNA, 20 nt, Artificial Sequence
  Synthetic
gcuccccuuuggggagggaa

SEQ ID NO: 10135 - RNA, 20 nt, Artificial Sequence
  Synthetic
ccuggugccugcgccuggaa

SEQ ID NO: 10136 - RNA, 20 nt, Artificial Sequence
  Synthetic
aaauacauguaaguuuauaa

SEQ ID NO: 10137 - RNA, 20 nt, Artificial Sequence
  Synthetic
agggaaaggaaggggacuaa

SEQ ID NO: 10138 - RNA, 20 nt, Artificial Sequence
  Synthetic
agugagcucuaccugggaca

SEQ ID NO: 10139 - RNA, 20 nt, Artificial Sequence
  Synthetic
ccuuccaggcgcaggcacca

SEQ ID NO: 10140 - RNA, 20 nt, Artificial Sequence
  Synthetic
gcgccuggaaggguggucca

SEQ ID NO: 10141 - RNA, 20 nt, Artificial Sequence
  Synthetic
guagaaacauaccuauagca

SEQ ID NO: 10142 - RNA, 20 nt, Artificial Sequence
  Synthetic
auacccggcaggacguggca

SEQ ID NO: 10143 - RNA, 20 nt, Artificial Sequence
  Synthetic
ggcaccagggaaggggcaga

SEQ ID NO: 10144 - RNA, 20 nt, Artificial Sequence
  Synthetic
cccuuuggggagggaaagga

SEQ ID NO: 10145 - RNA, 20 nt, Artificial Sequence
  Synthetic
ccaggcgcaggcaccaggga

SEQ ID NO: 10146 - RNA, 20 nt, Artificial Sequence
  Synthetic
ugguggcuccccuuugggga

SEQ ID NO: 10147 - RNA, 20 nt, Artificial Sequence
  Synthetic
cccuggugccugcgccugga

SEQ ID NO: 10148 - RNA, 20 nt, Artificial Sequence
  Synthetic
aggcagagccucagaccuga

SEQ ID NO: 10149 - RNA, 20 nt, Artificial Sequence
  Synthetic
gagggaaaggaaggggacua

SEQ ID NO: 10150 - RNA, 20 nt, Artificial Sequence
  Synthetic
cugccacguccugccgggua

SEQ ID NO: 10151 - RNA, 20 nt, Artificial Sequence
  Synthetic
auagacagauauacaaauua

SEQ ID NO: 10152 - RNA, 20 nt, Artificial Sequence
  Synthetic
gaccuggagcgggcuagaac

SEQ ID NO: 10153 - RNA, 20 nt, Artificial Sequence
  Synthetic
cagggugcugaggugcucac

SEQ ID NO: 10154 - RNA, 20 nt, Artificial Sequence
  Synthetic
uucuuauuuaucuuagagac

SEQ ID NO: 10155 - RNA, 20 nt, Artificial Sequence
  Synthetic
cagugagcucuaccugggac

SEQ ID NO: 10156 - RNA, 20 nt, Artificial Sequence
  Synthetic
cccuuccaggcgcaggcacc

SEQ ID NO: 10157 - RNA, 20 nt, Artificial Sequence
  Synthetic
ccuuuggcucagcccagacc

SEQ ID NO: 10158 - RNA, 20 nt, Artificial Sequence
  Synthetic
gaaaauagaaaucugagacc

SEQ ID NO: 10159 - RNA, 20 nt, Artificial Sequence
  Synthetic
gugcugcagcauucuagacc

SEQ ID NO: 10160 - RNA, 20 nt, Artificial Sequence
  Synthetic
cgcauugccacucccauacc

SEQ ID NO: 10161 - RNA, 20 nt, Artificial Sequence
  Synthetic
ugccagcagugagcucuacc

SEQ ID NO: 10162 - RNA, 20 nt, Artificial Sequence
  Synthetic
cagugagcaccucagcaccc

SEQ ID NO: 10163 - RNA, 20 nt, Artificial Sequence
  Synthetic
ggaacugacaccccuguccc

SEQ ID NO: 10164 - RNA, 20 nt, Artificial Sequence
  Synthetic
ccuucccuggugccugcgcc

SEQ ID NO: 10165 - RNA, 20 nt, Artificial Sequence
  Synthetic
ugacccugccacguccugcc

SEQ ID NO: 10166 - RNA, 20 nt, Artificial Sequence
  Synthetic
agccuguucuagcccgcucc

SEQ ID NO: 10167 - RNA, 20 nt, Artificial Sequence
  Synthetic
uggacuucugaccaaagucc

SEQ ID NO: 10168 - RNA, 20 nt, Artificial Sequence
  Synthetic
ugcgccuggaaggguggucc

SEQ ID NO: 10169 - RNA, 20 nt, Artificial Sequence
  Synthetic
gcacccuggaccacccuucc

SEQ ID NO: 10170 - RNA, 20 nt, Artificial Sequence
  Synthetic
cagcauucuagaccuggagc

SEQ ID NO: 10171 - RNA, 20 nt, Artificial Sequence
  Synthetic
uggaccacccuuccaggcgc

SEQ ID NO: 10172 - RNA, 20 nt, Artificial Sequence
  Synthetic
ucaugcacuauccucuaggc

SEQ ID NO: 10173 - RNA, 20 nt, Artificial Sequence
  Synthetic
uugccacucccauacccggc

SEQ ID NO: 10174 - RNA, 20 nt, Artificial Sequence
  Synthetic
ugcugaggugcucacugggc

SEQ ID NO: 10175 - RNA, 20 nt, Artificial Sequence
  Synthetic
cauacccggcaggacguggc

SEQ ID NO: 10176 - RNA, 20 nt, Artificial Sequence
  Synthetic
ucccagguagagcucacugc

SEQ ID NO: 10177 - RNA, 20 nt, Artificial Sequence
  Synthetic
gugacccugccacguccugc

SEQ ID NO: 10178 - RNA, 20 nt, Artificial Sequence
  Synthetic
gggugucaguucccacccuc

SEQ ID NO: 10179 - RNA, 20 nt, Artificial Sequence
  Synthetic
cuuccuuucccuccccaaag

SEQ ID NO: 10180 - RNA, 20 nt, Artificial Sequence
  Synthetic
cuuuggggagggaaaggaag

SEQ ID NO: 10181 - RNA, 20 nt, Artificial Sequence
  Synthetic
aggcgcaggcaccagggaag

SEQ ID NO: 10182 - RNA, 20 nt, Artificial Sequence
  Synthetic
gugagcucuaccugggacag

SEQ ID NO: 10183 - RNA, 20 nt, Artificial Sequence
  Synthetic
aggcaccagggaaggggcag

SEQ ID NO: 10184 - RNA, 20 nt, Artificial Sequence
  Synthetic
cguccugccggguaugggag

SEQ ID NO: 10185 - RNA, 20 nt, Artificial Sequence
  Synthetic
gcagcauucuagaccuggag

SEQ ID NO: 10186 - RNA, 20 nt, Artificial Sequence
  Synthetic
gcugcuguacuccagccuag

SEQ ID NO: 10187 - RNA, 20 nt, Artificial Sequence
  Synthetic
cucccauacccggcaggacg

SEQ ID NO: 10188 - RNA, 20 nt, Artificial Sequence
  Synthetic
gucugggcugagccaaaggg

SEQ ID NO: 10189 - RNA, 20 nt, Artificial Sequence
  Synthetic
ggugccugcgccuggaaggg

SEQ ID NO: 10190 - RNA, 20 nt, Artificial Sequence
  Synthetic
cagagccucagaccugaggg

SEQ ID NO: 10191 - RNA, 20 nt, Artificial Sequence
  Synthetic
augguggcuccccuuugggg

SEQ ID NO: 10192 - RNA, 20 nt, Artificial Sequence
  Synthetic
gacagauauacaaauuaugg

SEQ ID NO: 10193 - RNA, 20 nt, Artificial Sequence
  Synthetic
caggcagagccucagaccug

SEQ ID NO: 10194 - RNA, 20 nt, Artificial Sequence
  Synthetic
aagggugguccagggugcug

SEQ ID NO: 10195 - RNA, 20 nt, Artificial Sequence
  Synthetic
aguucccacccucaggucug

SEQ ID NO: 10196 - RNA, 20 nt, Artificial Sequence
  Synthetic
agaacaggcuugguguugug

SEQ ID NO: 10197 - RNA, 20 nt, Artificial Sequence
  Synthetic
auuaugguggcuccccuuug

SEQ ID NO: 10198 - RNA, 20 nt, Artificial Sequence
  Synthetic
uaugacagagaccaugcuau

SEQ ID NO: 10199 - RNA, 20 nt, Artificial Sequence
  Synthetic
ugccacguccugccggguau

SEQ ID NO: 10200 - RNA, 20 nt, Artificial Sequence
  Synthetic
gucuagaaugcugcagcacu

SEQ ID NO: 10201 - RNA, 20 nt, Artificial Sequence
  Synthetic
agggugcugaggugcucacu

SEQ ID NO: 10202 - RNA, 20 nt, Artificial Sequence
  Synthetic
gccagcagugagcucuaccu

SEQ ID NO: 10203 - RNA, 20 nt, Artificial Sequence
  Synthetic
ggagcgggcuagaacaggcu

SEQ ID NO: 10204 - RNA, 20 nt, Artificial Sequence
  Synthetic
aggaucaugcacuauccucu

SEQ ID NO: 10205 - RNA, 20 nt, Artificial Sequence
  Synthetic
agaauugcaaugccuggucu

SEQ ID NO: 10206 - RNA, 20 nt, Artificial Sequence
  Synthetic
agagccucagaccugagggu

SEQ ID NO: 10207 - RNA, 20 nt, Artificial Sequence
  Synthetic
gaaaucugagaccuggacuu

SEQ ID NO: 10208 - RNA, 20 nt, Artificial Sequence
  Synthetic
guggcagggucaccacccuu

SEQ ID NO: 10209 - RNA, 20 nt, Artificial Sequence
  Synthetic
aaauuaugguggcuccccuu

SEQ ID NO: 10210 - RNA, 20 nt, Artificial Sequence
  Synthetic
aauuaugguggcuccccuuu

SEQ ID NO: 10211 - RNA, 18 nt, Artificial Sequence
  Synthetic
gaaggagccagcaccaaa

SEQ ID NO: 10212 - RNA, 18 nt, Artificial Sequence
  Synthetic
gccagcgcuggaaaggaa

SEQ ID NO: 10213 - RNA, 19 nt, Artificial Sequence
  Synthetic
ggccagcgcuggaaaggaa

SEQ ID NO: 10214 - RNA, 21 nt, Artificial Sequence
  Synthetic
guggccagcgcuggaaaggaa

SEQ ID NO: 10215 - RNA, 24 nt, Artificial Sequence
  Synthetic
gauguggccagcgcuggaaaggaa

SEQ ID NO: 10216 - RNA, 18 nt, Artificial Sequence
  Synthetic
gcugaaucuugacaagca

SEQ ID NO: 10217 - RNA, 22 nt, Artificial Sequence
  Synthetic
guaaucgccccugcugugguca

SEQ ID NO: 10218 - RNA, 24 nt, Artificial Sequence
  Synthetic
guguaaucgccccugcugugguca

SEQ ID NO: 10219 - RNA, 18 nt, Artificial Sequence
  Synthetic
gugaaagccggugucaac

SEQ ID NO: 10220 - RNA, 19 nt, Artificial Sequence
  Synthetic
gaucggggcucaggugcac

SEQ ID NO: 10221 - RNA, 20 nt, Artificial Sequence
  Synthetic
ggaucggggcucaggugcac

SEQ ID NO: 10222 - RNA, 21 nt, Artificial Sequence
  Synthetic
gggaucggggcucaggugcac

SEQ ID NO: 10223 - RNA, 22 nt, Artificial Sequence
  Synthetic
ggggaucggggcucaggugcac

SEQ ID NO: 10224 - RNA, 23 nt, Artificial Sequence
  Synthetic
gggggaucggggcucaggugcac

SEQ ID NO: 10225 - RNA, 18 nt, Artificial Sequence
  Synthetic
gccagggauggaagcgac

SEQ ID NO: 10226 - RNA, 19 nt, Artificial Sequence
  Synthetic
ggccagggauggaagcgac

SEQ ID NO: 10227 - RNA, 22 nt, Artificial Sequence
  Synthetic
gccggccagggauggaagcgac

SEQ ID NO: 10228 - RNA, 23 nt, Artificial Sequence
  Synthetic
ggccggccagggauggaagcgac

SEQ ID NO: 10229 - RNA, 19 nt, Artificial Sequence
  Synthetic
gaagaaacugacccuuccc

SEQ ID NO: 10230 - RNA, 18 nt, Artificial Sequence
  Synthetic
gccccacaggaggcagcc

SEQ ID NO: 10231 - RNA, 19 nt, Artificial Sequence
  Synthetic
ggccccacaggaggcagcc

SEQ ID NO: 10232 - RNA, 20 nt, Artificial Sequence
  Synthetic
gggccccacaggaggcagcc

SEQ ID NO: 10233 - RNA, 19 nt, Artificial Sequence
  Synthetic
gcccgcccgcuggccggcc

SEQ ID NO: 10234 - RNA, 21 nt, Artificial Sequence
  Synthetic
gagcccgcccgcuggccggcc

SEQ ID NO: 10235 - RNA, 22 nt, Artificial Sequence
  Synthetic
ggagcccgcccgcuggccggcc

SEQ ID NO: 10236 - RNA, 23 nt, Artificial Sequence
  Synthetic
gggagcccgcccgcuggccggcc

SEQ ID NO: 10237 - RNA, 24 nt, Artificial Sequence
  Synthetic
ggggagcccgcccgcuggccggcc

SEQ ID NO: 10238 - RNA, 18 nt, Artificial Sequence
  Synthetic
ggaggcagcccagagugc

SEQ ID NO: 10239 - RNA, 19 nt, Artificial Sequence
  Synthetic
gcuguggucacagaguugc

SEQ ID NO: 10240 - RNA, 18 nt, Artificial Sequence
  Synthetic
ggacugguuccuuuccag

SEQ ID NO: 10241 - RNA, 19 nt, Artificial Sequence
  Synthetic
gggacugguuccuuuccag

SEQ ID NO: 10242 - RNA, 23 nt, Artificial Sequence
  Synthetic
gacugggacugguuccuuuccag

SEQ ID NO: 10243 - RNA, 24 nt, Artificial Sequence
  Synthetic
ggacugggacugguuccuuuccag

SEQ ID NO: 10244 - RNA, 19 nt, Artificial Sequence
  Synthetic
gcagcaaaaggauaaggag

SEQ ID NO: 10245 - RNA, 21 nt, Artificial Sequence
  Synthetic
ggcaaagaucugaacaaguag

SEQ ID NO: 10246 - RNA, 22 nt, Artificial Sequence
  Synthetic
gggcaaagaucugaacaaguag

SEQ ID NO: 10247 - RNA, 23 nt, Artificial Sequence
  Synthetic
ggggcaaagaucugaacaaguag

SEQ ID NO: 10248 - RNA, 20 nt, Artificial Sequence
  Synthetic
gcaggcacugaaggugcagg

SEQ ID NO: 10249 - RNA, 18 nt, Artificial Sequence
  Synthetic
gggagcagcgcacucagg

SEQ ID NO: 10250 - RNA, 21 nt, Artificial Sequence
  Synthetic
gauucgucugcucucugggug

SEQ ID NO: 10251 - RNA, 22 nt, Artificial Sequence
  Synthetic
ggauucgucugcucucugggug

SEQ ID NO: 10252 - RNA, 24 nt, Artificial Sequence
  Synthetic
guggauucgucugcucucugggug

SEQ ID NO: 10253 - RNA, 21 nt, Artificial Sequence
  Synthetic
gcccguggauucgucugcucu

SEQ ID NO: 10254 - RNA, 23 nt, Artificial Sequence
  Synthetic
gagcccguggauucgucugcucu

SEQ ID NO: 10255 - RNA, 20 nt, Artificial Sequence
  Synthetic
gcagagcuauaaacagaauu

SEQ ID NO: 10256 - RNA, 22 nt, Artificial Sequence
  Synthetic
gagcagagcuauaaacagaauu

SEQ ID NO: 10257 - RNA, 23 nt, Artificial Sequence
  Synthetic
ggagcagagcuauaaacagaauu

SEQ ID NO: 10258 - RNA, 22 nt, Artificial Sequence
  Synthetic
gcuucccugauagggccaccuu

SEQ ID NO: 10259 - RNA, 20 nt, Artificial Sequence
  Synthetic
gccaacaguguaaaaaagaa

SEQ ID NO: 10260 - RNA, 23 nt, Artificial Sequence
  Synthetic
gcagccaacaguguaaaaaagaa

SEQ ID NO: 10261 - RNA, 24 nt, Artificial Sequence
  Synthetic
ggcagccaacaguguaaaaaagaa

SEQ ID NO: 10262 - RNA, 19 nt, Artificial Sequence
  Synthetic
gagaaaauauagcccauca

SEQ ID NO: 10263 - RNA, 20 nt, Artificial Sequence
  Synthetic
ggagaaaauauagcccauca

SEQ ID NO: 10264 - RNA, 18 nt, Artificial Sequence
  Synthetic
gcaguccuggggcagaga

SEQ ID NO: 10265 - RNA, 18 nt, Artificial Sequence
  Synthetic
ggucuggacaagguugga

SEQ ID NO: 10266 - RNA, 19 nt, Artificial Sequence
  Synthetic
gggucuggacaagguugga

SEQ ID NO: 10267 - RNA, 18 nt, Artificial Sequence
  Synthetic
gaggcagacgcaucccac

SEQ ID NO: 10268 - RNA, 19 nt, Artificial Sequence
  Synthetic
ggaggcagacgcaucccac

SEQ ID NO: 10269 - RNA, 21 nt, Artificial Sequence
  Synthetic
gaggaggcagacgcaucccac

SEQ ID NO: 10270 - RNA, 22 nt, Artificial Sequence
  Synthetic
ggaggaggcagacgcaucccac

SEQ ID NO: 10271 - RNA, 19 nt, Artificial Sequence
  Synthetic
gaccuggcucaagggagac

SEQ ID NO: 10272 - RNA, 21 nt, Artificial Sequence
  Synthetic
gcaccugagccccgauccccc

SEQ ID NO: 10273 - RNA, 23 nt, Artificial Sequence
  Synthetic
gugcaccugagccccgauccccc

SEQ ID NO: 10274 - RNA, 24 nt, Artificial Sequence
  Synthetic
ggugcaccugagccccgauccccc

SEQ ID NO: 10275 - RNA, 21 nt, Artificial Sequence
  Synthetic
gaccagguuggacccugagcc

SEQ ID NO: 10276 - RNA, 18 nt, Artificial Sequence
  Synthetic
gcgucuaaagccccugcc

SEQ ID NO: 10277 - RNA, 22 nt, Artificial Sequence
  Synthetic
gucugcgucuaaagccccugcc

SEQ ID NO: 10278 - RNA, 21 nt, Artificial Sequence
  Synthetic
gaaccuuugagaucaaacagc

SEQ ID NO: 10279 - RNA, 23 nt, Artificial Sequence
  Synthetic
gccuucccugccgcgugcagggc

SEQ ID NO: 10280 - RNA, 18 nt, Artificial Sequence
  Synthetic
gcuucaccugggccccuc

SEQ ID NO: 10281 - RNA, 18 nt, Artificial Sequence
  Synthetic
guuguguggguggcucuc

SEQ ID NO: 10282 - RNA, 19 nt, Artificial Sequence
  Synthetic
gguuguguggguggcucuc

SEQ ID NO: 10283 - RNA, 20 nt, Artificial Sequence
  Synthetic
ggguuguguggguggcucuc

SEQ ID NO: 10284 - RNA, 18 nt, Artificial Sequence
  Synthetic
ggaguuucuaggggucuc

SEQ ID NO: 10285 - RNA, 22 nt, Artificial Sequence
  Synthetic
gacuggaguuucuaggggucuc

SEQ ID NO: 10286 - RNA, 24 nt, Artificial Sequence
  Synthetic
gagacuggaguuucuaggggucuc

SEQ ID NO: 10287 - RNA, 24 nt, Artificial Sequence
  Synthetic
gauaacccagcacccagagagcag

SEQ ID NO: 10288 - RNA, 19 nt, Artificial Sequence
  Synthetic
gauagccccagaggaggag

SEQ ID NO: 10289 - RNA, 22 nt, Artificial Sequence
  Synthetic
guagauagccccagaggaggag

SEQ ID NO: 10290 - RNA, 19 nt, Artificial Sequence
  Synthetic
gagugggagaaugugggcg

SEQ ID NO: 10291 - RNA, 20 nt, Artificial Sequence
  Synthetic
ggagugggagaaugugggcg

SEQ ID NO: 10292 - RNA, 22 nt, Artificial Sequence
  Synthetic
gacaagguuggaggggguggcg

SEQ ID NO: 10293 - RNA, 23 nt, Artificial Sequence
  Synthetic
ggacaagguuggaggggguggcg

SEQ ID NO: 10294 - RNA, 18 nt, Artificial Sequence
  Synthetic
gcugccuuaagcuagugg

SEQ ID NO: 10295 - RNA, 23 nt, Artificial Sequence
  Synthetic
gccaugcugccuuaagcuagugg

SEQ ID NO: 10296 - RNA, 21 nt, Artificial Sequence
  Synthetic
gucccaguccagccgcaaccu

SEQ ID NO: 10297 - RNA, 21 nt, Artificial Sequence
  Synthetic
gccugagggugaggcugaccu

SEQ ID NO: 10298 - RNA, 22 nt, Artificial Sequence
  Synthetic
ggccugagggugaggcugaccu

SEQ ID NO: 10299 - RNA, 23 nt, Artificial Sequence
  Synthetic
gggccugagggugaggcugaccu

SEQ ID NO: 10300 - RNA, 19 nt, Artificial Sequence
  Synthetic
gcccuccuagcugugggcu

SEQ ID NO: 10301 - RNA, 23 nt, Artificial Sequence
  Synthetic
gcucaagggagacuggaguuucu

SEQ ID NO: 10302 - RNA, 24 nt, Artificial Sequence
  Synthetic
ggcucaagggagacuggaguuucu

SEQ ID NO: 10303 - RNA, 19 nt, Artificial Sequence
  Synthetic
gaauccacgggcucugugu

SEQ ID NO: 10304 - RNA, 22 nt, Artificial Sequence
  Synthetic
gacgaauccacgggcucugugu

SEQ ID NO: 10305 - RNA, 18 nt, Artificial Sequence
  Synthetic
gugcagggccuggguugu

SEQ ID NO: 10306 - RNA, 20 nt, Artificial Sequence
  Synthetic
gcgugcagggccuggguugu

SEQ ID NO: 10307 - RNA, 23 nt, Artificial Sequence
  Synthetic
gccgcgugcagggccuggguugu

SEQ ID NO: 10308 - RNA, 19 nt, Artificial Sequence
  Synthetic
gagucuccuccagcccuuu

SEQ ID NO: 10309 - RNA, 19 nt, Artificial Sequence
  Synthetic
agaaggagccagcaccaaa

SEQ ID NO: 10310 - RNA, 18 nt, Artificial Sequence
  Synthetic
uaggagcagagcuauaaa

SEQ ID NO: 10311 - RNA, 19 nt, Artificial Sequence
  Synthetic
auaggagcagagcuauaaa

SEQ ID NO: 10312 - RNA, 20 nt, Artificial Sequence
  Synthetic
aauaggagcagagcuauaaa

SEQ ID NO: 10313 - RNA, 21 nt, Artificial Sequence
  Synthetic
aaauaggagcagagcuauaaa

SEQ ID NO: 10314 - RNA, 22 nt, Artificial Sequence
  Synthetic
aaaauaggagcagagcuauaaa

SEQ ID NO: 10315 - RNA, 23 nt, Artificial Sequence
  Synthetic
caaaauaggagcagagcuauaaa

SEQ ID NO: 10316 - RNA, 24 nt, Artificial Sequence
  Synthetic
acaaaauaggagcagagcuauaaa

SEQ ID NO: 10317 - RNA, 21 nt, Artificial Sequence
  Synthetic
uuuccaaacuuaaugcagcaa

SEQ ID NO: 10318 - RNA, 22 nt, Artificial Sequence
  Synthetic
cuuuccaaacuuaaugcagcaa

SEQ ID NO: 10319 - RNA, 23 nt, Artificial Sequence
  Synthetic
ucuuuccaaacuuaaugcagcaa

SEQ ID NO: 10320 - RNA, 24 nt, Artificial Sequence
  Synthetic
cucuuuccaaacuuaaugcagcaa

SEQ ID NO: 10321 - RNA, 20 nt, Artificial Sequence
  Synthetic
uggccagcgcuggaaaggaa

SEQ ID NO: 10322 - RNA, 22 nt, Artificial Sequence
  Synthetic
uguggccagcgcuggaaaggaa

SEQ ID NO: 10323 - RNA, 23 nt, Artificial Sequence
  Synthetic
auguggccagcgcuggaaaggaa

SEQ ID NO: 10324 - RNA, 19 nt, Artificial Sequence
  Synthetic
ugcugaaucuugacaagca

SEQ ID NO: 10325 - RNA, 21 nt, Artificial Sequence
  Synthetic
ucugcugaaucuugacaagca

SEQ ID NO: 10326 - RNA, 22 nt, Artificial Sequence
  Synthetic
cucugcugaaucuugacaagca

SEQ ID NO: 10327 - RNA, 23 nt, Artificial Sequence
  Synthetic
ucucugcugaaucuugacaagca

SEQ ID NO: 10328 - RNA, 24 nt, Artificial Sequence
  Synthetic
aucucugcugaaucuugacaagca

SEQ ID NO: 10329 - RNA, 18 nt, Artificial Sequence
  Synthetic
agggauggaggaggggca

SEQ ID NO: 10330 - RNA, 19 nt, Artificial Sequence
  Synthetic
uagggauggaggaggggca

SEQ ID NO: 10331 - RNA, 20 nt, Artificial Sequence
  Synthetic
auagggauggaggaggggca

SEQ ID NO: 10332 - RNA, 18 nt, Artificial Sequence
  Synthetic
ucgccccugcugugguca

SEQ ID NO: 10333 - RNA, 19 nt, Artificial Sequence
  Synthetic
aucgccccugcugugguca

SEQ ID NO: 10334 - RNA, 20 nt, Artificial Sequence
  Synthetic
aaucgccccugcugugguca

SEQ ID NO: 10335 - RNA, 21 nt, Artificial Sequence
  Synthetic
uaaucgccccugcugugguca

SEQ ID NO: 10336 - RNA, 23 nt, Artificial Sequence
  Synthetic
uguaaucgccccugcugugguca

SEQ ID NO: 10337 - RNA, 18 nt, Artificial Sequence
  Synthetic
uaaugcagcaaaaggaua

SEQ ID NO: 10338 - RNA, 19 nt, Artificial Sequence
  Synthetic
uuaaugcagcaaaaggaua

SEQ ID NO: 10339 - RNA, 19 nt, Artificial Sequence
  Synthetic
agugaaagccggugucaac

SEQ ID NO: 10340 - RNA, 20 nt, Artificial Sequence
  Synthetic
aagugaaagccggugucaac

SEQ ID NO: 10341 - RNA, 21 nt, Artificial Sequence
  Synthetic
aaagugaaagccggugucaac

SEQ ID NO: 10342 - RNA, 22 nt, Artificial Sequence
  Synthetic
uaaagugaaagccggugucaac

SEQ ID NO: 10343 - RNA, 23 nt, Artificial Sequence
  Synthetic
uuaaagugaaagccggugucaac

SEQ ID NO: 10344 - RNA, 24 nt, Artificial Sequence
  Synthetic
cuuaaagugaaagccggugucaac

SEQ ID NO: 10345 - RNA, 18 nt, Artificial Sequence
  Synthetic
aucggggcucaggugcac

SEQ ID NO: 10346 - RNA, 24 nt, Artificial Sequence
  Synthetic
ugggggaucggggcucaggugcac

SEQ ID NO: 10347 - RNA, 21 nt, Artificial Sequence
  Synthetic
ccggccagggauggaagcgac

SEQ ID NO: 10348 - RNA, 24 nt, Artificial Sequence
  Synthetic
uggccggccagggauggaagcgac

SEQ ID NO: 10349 - RNA, 18 nt, Artificial Sequence
  Synthetic
cacucccacacagagccc

SEQ ID NO: 10350 - RNA, 19 nt, Artificial Sequence
  Synthetic
ucacucccacacagagccc

SEQ ID NO: 10351 - RNA, 20 nt, Artificial Sequence
  Synthetic
cucacucccacacagagccc

SEQ ID NO: 10352 - RNA, 18 nt, Artificial Sequence
  Synthetic
aagaaacugacccuuccc

SEQ ID NO: 10353 - RNA, 20 nt, Artificial Sequence
  Synthetic
ugaagaaacugacccuuccc

SEQ ID NO: 10354 - RNA, 21 nt, Artificial Sequence
  Synthetic
augaagaaacugacccuuccc

SEQ ID NO: 10355 - RNA, 22 nt, Artificial Sequence
  Synthetic
aaugaagaaacugacccuuccc

SEQ ID NO: 10356 - RNA, 23 nt, Artificial Sequence
  Synthetic
uaaugaagaaacugacccuuccc

SEQ ID NO: 10357 - RNA, 24 nt, Artificial Sequence
  Synthetic
cuaaugaagaaacugacccuuccc

SEQ ID NO: 10358 - RNA, 21 nt, Artificial Sequence
  Synthetic
cgggccccacaggaggcagcc

SEQ ID NO: 10359 - RNA, 22 nt, Artificial Sequence
  Synthetic
acgggccccacaggaggcagcc

SEQ ID NO: 10360 - RNA, 23 nt, Artificial Sequence
  Synthetic
cacgggccccacaggaggcagcc

SEQ ID NO: 10361 - RNA, 24 nt, Artificial Sequence
  Synthetic
ucacgggccccacaggaggcagcc

SEQ ID NO: 10362 - RNA, 18 nt, Artificial Sequence
  Synthetic
ugaggaggagucagagcc

SEQ ID NO: 10363 - RNA, 19 nt, Artificial Sequence
  Synthetic
cugaggaggagucagagcc

SEQ ID NO: 10364 - RNA, 18 nt, Artificial Sequence
  Synthetic
acuguuggcugccaggcc

SEQ ID NO: 10365 - RNA, 19 nt, Artificial Sequence
  Synthetic
cacuguuggcugccaggcc

SEQ ID NO: 10366 - RNA, 21 nt, Artificial Sequence
  Synthetic
uacacuguuggcugccaggcc

SEQ ID NO: 10367 - RNA, 22 nt, Artificial Sequence
  Synthetic
uuacacuguuggcugccaggcc

SEQ ID NO: 10368 - RNA, 23 nt, Artificial Sequence
  Synthetic
uuuacacuguuggcugccaggcc

SEQ ID NO: 10369 - RNA, 24 nt, Artificial Sequence
  Synthetic
uuuuacacuguuggcugccaggcc

SEQ ID NO: 10370 - RNA, 18 nt, Artificial Sequence
  Synthetic
cccgcccgcuggccggcc

SEQ ID NO: 10371 - RNA, 18 nt, Artificial Sequence
  Synthetic
uggagccagcagaccugc

SEQ ID NO: 10372 - RNA, 19 nt, Artificial Sequence
  Synthetic
cuggagccagcagaccugc

SEQ ID NO: 10373 - RNA, 19 nt, Artificial Sequence
  Synthetic
aggaggcagcccagagugc

SEQ ID NO: 10374 - RNA, 21 nt, Artificial Sequence
  Synthetic
acaggaggcagcccagagugc

SEQ ID NO: 10375 - RNA, 22 nt, Artificial Sequence
  Synthetic
cacaggaggcagcccagagugc

SEQ ID NO: 10376 - RNA, 23 nt, Artificial Sequence
  Synthetic
ccacaggaggcagcccagagugc

SEQ ID NO: 10377 - RNA, 24 nt, Artificial Sequence
  Synthetic
cccacaggaggcagcccagagugc

SEQ ID NO: 10378 - RNA, 18 nt, Artificial Sequence
  Synthetic
cuguggucacagaguugc

SEQ ID NO: 10379 - RNA, 21 nt, Artificial Sequence
  Synthetic
cugcuguggucacagaguugc

SEQ ID NO: 10380 - RNA, 22 nt, Artificial Sequence
  Synthetic
ccugcuguggucacagaguugc

SEQ ID NO: 10381 - RNA, 23 nt, Artificial Sequence
  Synthetic
cccugcuguggucacagaguugc

SEQ ID NO: 10382 - RNA, 24 nt, Artificial Sequence
  Synthetic
ccccugcuguggucacagaguugc

SEQ ID NO: 10383 - RNA, 18 nt, Artificial Sequence
  Synthetic
ccuuuggucuucuuccuc

SEQ ID NO: 10384 - RNA, 19 nt, Artificial Sequence
  Synthetic
uccuuuggucuucuuccuc

SEQ ID NO: 10385 - RNA, 20 nt, Artificial Sequence
  Synthetic
uuccuuuggucuucuuccuc

SEQ ID NO: 10386 - RNA, 20 nt, Artificial Sequence
  Synthetic
ugggacugguuccuuuccag

SEQ ID NO: 10387 - RNA, 21 nt, Artificial Sequence
  Synthetic
cugggacugguuccuuuccag

SEQ ID NO: 10388 - RNA, 22 nt, Artificial Sequence
  Synthetic
acugggacugguuccuuuccag

SEQ ID NO: 10389 - RNA, 18 nt, Artificial Sequence
  Synthetic
cagcaaaaggauaaggag

SEQ ID NO: 10390 - RNA, 21 nt, Artificial Sequence
  Synthetic
augcagcaaaaggauaaggag

SEQ ID NO: 10391 - RNA, 22 nt, Artificial Sequence
  Synthetic
aaugcagcaaaaggauaaggag

SEQ ID NO: 10392 - RNA, 23 nt, Artificial Sequence
  Synthetic
uaaugcagcaaaaggauaaggag

SEQ ID NO: 10393 - RNA, 24 nt, Artificial Sequence
  Synthetic
uuaaugcagcaaaaggauaaggag

SEQ ID NO: 10394 - RNA, 18 nt, Artificial Sequence
  Synthetic
uaucaagggcucugugag

SEQ ID NO: 10395 - RNA, 19 nt, Artificial Sequence
  Synthetic
auaucaagggcucugugag

SEQ ID NO: 10396 - RNA, 20 nt, Artificial Sequence
  Synthetic
cauaucaagggcucugugag

SEQ ID NO: 10397 - RNA, 21 nt, Artificial Sequence
  Synthetic
ucauaucaagggcucugugag

SEQ ID NO: 10398 - RNA, 22 nt, Artificial Sequence
  Synthetic
uucauaucaagggcucugugag

SEQ ID NO: 10399 - RNA, 23 nt, Artificial Sequence
  Synthetic
uuucauaucaagggcucugugag

SEQ ID NO: 10400 - RNA, 24 nt, Artificial Sequence
  Synthetic
uuuucauaucaagggcucugugag

SEQ ID NO: 10401 - RNA, 24 nt, Artificial Sequence
  Synthetic
aggggcaaagaucugaacaaguag

SEQ ID NO: 10402 - RNA, 18 nt, Artificial Sequence
  Synthetic
aggcacugaaggugcagg

SEQ ID NO: 10403 - RNA, 19 nt, Artificial Sequence
  Synthetic
caggcacugaaggugcagg

SEQ ID NO: 10404 - RNA, 19 nt, Artificial Sequence
  Synthetic
ugggagcagcgcacucagg

SEQ ID NO: 10405 - RNA, 21 nt, Artificial Sequence
  Synthetic
agugggagcagcgcacucagg

SEQ ID NO: 10406 - RNA, 22 nt, Artificial Sequence
  Synthetic
aagugggagcagcgcacucagg

SEQ ID NO: 10407 - RNA, 23 nt, Artificial Sequence
  Synthetic
uaagugggagcagcgcacucagg

SEQ ID NO: 10408 - RNA, 24 nt, Artificial Sequence
  Synthetic
cuaagugggagcagcgcacucagg

SEQ ID NO: 10409 - RNA, 18 nt, Artificial Sequence
  Synthetic
caggaaggagagcaaggg

SEQ ID NO: 10410 - RNA, 19 nt, Artificial Sequence
  Synthetic
ccaggaaggagagcaaggg

SEQ ID NO: 10411 - RNA, 18 nt, Artificial Sequence
  Synthetic
uccugagacagacucaug

SEQ ID NO: 10412 - RNA, 19 nt, Artificial Sequence
  Synthetic
uuccugagacagacucaug

SEQ ID NO: 10413 - RNA, 21 nt, Artificial Sequence
  Synthetic
acuuccugagacagacucaug

SEQ ID NO: 10414 - RNA, 22 nt, Artificial Sequence
  Synthetic
uacuuccugagacagacucaug

SEQ ID NO: 10415 - RNA, 23 nt, Artificial Sequence
  Synthetic
uuacuuccugagacagacucaug

SEQ ID NO: 10416 - RNA, 24 nt, Artificial Sequence
  Synthetic
uuuacuuccugagacagacucaug

SEQ ID NO: 10417 - RNA, 18 nt, Artificial Sequence
  Synthetic
ucgucugcucucugggug

SEQ ID NO: 10418 - RNA, 19 nt, Artificial Sequence
  Synthetic
uucgucugcucucugggug

SEQ ID NO: 10419 - RNA, 20 nt, Artificial Sequence
  Synthetic
auucgucugcucucugggug

SEQ ID NO: 10420 - RNA, 23 nt, Artificial Sequence
  Synthetic
uggauucgucugcucucugggug

SEQ ID NO: 10421 - RNA, 18 nt, Artificial Sequence
  Synthetic
agcgaaggacagagagau

SEQ ID NO: 10422 - RNA, 19 nt, Artificial Sequence
  Synthetic
cagcgaaggacagagagau

SEQ ID NO: 10423 - RNA, 18 nt, Artificial Sequence
  Synthetic
cccgagggcaggugaacu

SEQ ID NO: 10424 - RNA, 19 nt, Artificial Sequence
  Synthetic
ucccgagggcaggugaacu

SEQ ID NO: 10425 - RNA, 18 nt, Artificial Sequence
  Synthetic
aaggcaguacuccaggcu

SEQ ID NO: 10426 - RNA, 19 nt, Artificial Sequence
  Synthetic
aaaggcaguacuccaggcu

SEQ ID NO: 10427 - RNA, 20 nt, Artificial Sequence
  Synthetic
aaaaggcaguacuccaggcu

SEQ ID NO: 10428 - RNA, 18 nt, Artificial Sequence
  Synthetic
cguggauucgucugcucu

SEQ ID NO: 10429 - RNA, 19 nt, Artificial Sequence
  Synthetic
ccguggauucgucugcucu

SEQ ID NO: 10430 - RNA, 20 nt, Artificial Sequence
  Synthetic
cccguggauucgucugcucu

SEQ ID NO: 10431 - RNA, 22 nt, Artificial Sequence
  Synthetic
agcccguggauucgucugcucu

SEQ ID NO: 10432 - RNA, 24 nt, Artificial Sequence
  Synthetic
agagcccguggauucgucugcucu

SEQ ID NO: 10433 - RNA, 18 nt, Artificial Sequence
  Synthetic
ucugccuucuguuucucu

SEQ ID NO: 10434 - RNA, 19 nt, Artificial Sequence
  Synthetic
aucugccuucuguuucucu

SEQ ID NO: 10435 - RNA, 20 nt, Artificial Sequence
  Synthetic
uaucugccuucuguuucucu

SEQ ID NO: 10436 - RNA, 21 nt, Artificial Sequence
  Synthetic
cuaucugccuucuguuucucu

SEQ ID NO: 10437 - RNA, 22 nt, Artificial Sequence
  Synthetic
ucuaucugccuucuguuucucu

SEQ ID NO: 10438 - RNA, 23 nt, Artificial Sequence
  Synthetic
cucuaucugccuucuguuucucu

SEQ ID NO: 10439 - RNA, 24 nt, Artificial Sequence
  Synthetic
ucucuaucugccuucuguuucucu

SEQ ID NO: 10440 - RNA, 18 nt, Artificial Sequence
  Synthetic
agagcuauaaacagaauu

SEQ ID NO: 10441 - RNA, 19 nt, Artificial Sequence
  Synthetic
cagagcuauaaacagaauu

SEQ ID NO: 10442 - RNA, 21 nt, Artificial Sequence
  Synthetic
agcagagcuauaaacagaauu

SEQ ID NO: 10443 - RNA, 24 nt, Artificial Sequence
  Synthetic
aggagcagagcuauaaacagaauu

SEQ ID NO: 10444 - RNA, 21 nt, Artificial Sequence
  Synthetic
cuucccugauagggccaccuu

SEQ ID NO: 10445 - RNA, 23 nt, Artificial Sequence
  Synthetic
ugcuucccugauagggccaccuu

SEQ ID NO: 10446 - RNA, 24 nt, Artificial Sequence
  Synthetic
cugcuucccugauagggccaccuu

SEQ ID NO: 10447 - RNA, 18 nt, Artificial Sequence
  Synthetic
caacaguguaaaaaagaa

SEQ ID NO: 10448 - RNA, 19 nt, Artificial Sequence
  Synthetic
ccaacaguguaaaaaagaa

SEQ ID NO: 10449 - RNA, 21 nt, Artificial Sequence
  Synthetic
agccaacaguguaaaaaagaa

SEQ ID NO: 10450 - RNA, 22 nt, Artificial Sequence
  Synthetic
cagccaacaguguaaaaaagaa

SEQ ID NO: 10451 - RNA, 18 nt, Artificial Sequence
  Synthetic
agaaaauauagcccauca

SEQ ID NO: 10452 - RNA, 19 nt, Artificial Sequence
  Synthetic
ugcaguccuggggcagaga

SEQ ID NO: 10453 - RNA, 20 nt, Artificial Sequence
  Synthetic
cugcaguccuggggcagaga

SEQ ID NO: 10454 - RNA, 21 nt, Artificial Sequence
  Synthetic
ccgggucuggacaagguugga

SEQ ID NO: 10455 - RNA, 22 nt, Artificial Sequence
  Synthetic
cccgggucuggacaagguugga

SEQ ID NO: 10456 - RNA, 23 nt, Artificial Sequence
  Synthetic
ucccgggucuggacaagguugga

SEQ ID NO: 10457 - RNA, 24 nt, Artificial Sequence
  Synthetic
cucccgggucuggacaagguugga

SEQ ID NO: 10458 - RNA, 20 nt, Artificial Sequence
  Synthetic
aggaggcagacgcaucccac

SEQ ID NO: 10459 - RNA, 23 nt, Artificial Sequence
  Synthetic
aggaggaggcagacgcaucccac

SEQ ID NO: 10460 - RNA, 24 nt, Artificial Sequence
  Synthetic
caggaggaggcagacgcaucccac

SEQ ID NO: 10461 - RNA, 18 nt, Artificial Sequence
  Synthetic
accuggcucaagggagac

SEQ ID NO: 10462 - RNA, 18 nt, Artificial Sequence
  Synthetic
ccugagccccgauccccc

SEQ ID NO: 10463 - RNA, 19 nt, Artificial Sequence
  Synthetic
accugagccccgauccccc

SEQ ID NO: 10464 - RNA, 20 nt, Artificial Sequence
  Synthetic
caccugagccccgauccccc

SEQ ID NO: 10465 - RNA, 22 nt, Artificial Sequence
  Synthetic
ugcaccugagccccgauccccc

SEQ ID NO: 10466 - RNA, 18 nt, Artificial Sequence
  Synthetic
cagguuggacccugagcc

SEQ ID NO: 10467 - RNA, 19 nt, Artificial Sequence
  Synthetic
ccagguuggacccugagcc

SEQ ID NO: 10468 - RNA, 22 nt, Artificial Sequence
  Synthetic
agaccagguuggacccugagcc

SEQ ID NO: 10469 - RNA, 23 nt, Artificial Sequence
  Synthetic
cagaccagguuggacccugagcc

SEQ ID NO: 10470 - RNA, 24 nt, Artificial Sequence
  Synthetic
acagaccagguuggacccugagcc

SEQ ID NO: 10471 - RNA, 19 nt, Artificial Sequence
  Synthetic
ugcgucuaaagccccugcc

SEQ ID NO: 10472 - RNA, 20 nt, Artificial Sequence
  Synthetic
cugcgucuaaagccccugcc

SEQ ID NO: 10473 - RNA, 21 nt, Artificial Sequence
  Synthetic
ucugcgucuaaagccccugcc

SEQ ID NO: 10474 - RNA, 23 nt, Artificial Sequence
  Synthetic
ugucugcgucuaaagccccugcc

SEQ ID NO: 10475 - RNA, 24 nt, Artificial Sequence
  Synthetic
cugucugcgucuaaagccccugcc

SEQ ID NO: 10476 - RNA, 18 nt, Artificial Sequence
  Synthetic
ccuuugagaucaaacagc

SEQ ID NO: 10477 - RNA, 19 nt, Artificial Sequence
  Synthetic
accuuugagaucaaacagc

SEQ ID NO: 10478 - RNA, 20 nt, Artificial Sequence
  Synthetic
aaccuuugagaucaaacagc

SEQ ID NO: 10479 - RNA, 22 nt, Artificial Sequence
  Synthetic
agaaccuuugagaucaaacagc

SEQ ID NO: 10480 - RNA, 23 nt, Artificial Sequence
  Synthetic
cagaaccuuugagaucaaacagc

SEQ ID NO: 10481 - RNA, 24 nt, Artificial Sequence
  Synthetic
ucagaaccuuugagaucaaacagc

SEQ ID NO: 10482 - RNA, 18 nt, Artificial Sequence
  Synthetic
cccugccgcgugcagggc

SEQ ID NO: 10483 - RNA, 19 nt, Artificial Sequence
  Synthetic
ucccugccgcgugcagggc

SEQ ID NO: 10484 - RNA, 20 nt, Artificial Sequence
  Synthetic
uucccugccgcgugcagggc

SEQ ID NO: 10485 - RNA, 21 nt, Artificial Sequence
  Synthetic
cuucccugccgcgugcagggc

SEQ ID NO: 10486 - RNA, 22 nt, Artificial Sequence
  Synthetic
ccuucccugccgcgugcagggc

SEQ ID NO: 10487 - RNA, 24 nt, Artificial Sequence
  Synthetic
agccuucccugccgcgugcagggc

SEQ ID NO: 10488 - RNA, 19 nt, Artificial Sequence
  Synthetic
agcuucaccugggccccuc

SEQ ID NO: 10489 - RNA, 20 nt, Artificial Sequence
  Synthetic
cagcuucaccugggccccuc

SEQ ID NO: 10490 - RNA, 21 nt, Artificial Sequence
  Synthetic
ccagcuucaccugggccccuc

SEQ ID NO: 10491 - RNA, 22 nt, Artificial Sequence
  Synthetic
cccagcuucaccugggccccuc

SEQ ID NO: 10492 - RNA, 23 nt, Artificial Sequence
  Synthetic
ccccagcuucaccugggccccuc

SEQ ID NO: 10493 - RNA, 24 nt, Artificial Sequence
  Synthetic
cccccagcuucaccugggccccuc

SEQ ID NO: 10494 - RNA, 19 nt, Artificial Sequence
  Synthetic
uggaguuucuaggggucuc

SEQ ID NO: 10495 - RNA, 21 nt, Artificial Sequence
  Synthetic
acuggaguuucuaggggucuc

SEQ ID NO: 10496 - RNA, 23 nt, Artificial Sequence
  Synthetic
agacuggaguuucuaggggucuc

SEQ ID NO: 10497 - RNA, 18 nt, Artificial Sequence
  Synthetic
ccagcacccagagagcag

SEQ ID NO: 10498 - RNA, 19 nt, Artificial Sequence
  Synthetic
cccagcacccagagagcag

SEQ ID NO: 10499 - RNA, 20 nt, Artificial Sequence
  Synthetic
acccagcacccagagagcag

SEQ ID NO: 10500 - RNA, 21 nt, Artificial Sequence
  Synthetic
aacccagcacccagagagcag

SEQ ID NO: 10501 - RNA, 22 nt, Artificial Sequence
  Synthetic
uaacccagcacccagagagcag

SEQ ID NO: 10502 - RNA, 23 nt, Artificial Sequence
  Synthetic
auaacccagcacccagagagcag

SEQ ID NO: 10503 - RNA, 18 nt, Artificial Sequence
  Synthetic
auagccccagaggaggag

SEQ ID NO: 10504 - RNA, 20 nt, Artificial Sequence
  Synthetic
agauagccccagaggaggag

SEQ ID NO: 10505 - RNA, 21 nt, Artificial Sequence
  Synthetic
uagauagccccagaggaggag

SEQ ID NO: 10506 - RNA, 23 nt, Artificial Sequence
  Synthetic
aguagauagccccagaggaggag

SEQ ID NO: 10507 - RNA, 24 nt, Artificial Sequence
  Synthetic
aaguagauagccccagaggaggag

SEQ ID NO: 10508 - RNA, 18 nt, Artificial Sequence
  Synthetic
agugggagaaugugggcg

SEQ ID NO: 10509 - RNA, 18 nt, Artificial Sequence
  Synthetic
agguuggaggggguggcg

SEQ ID NO: 10510 - RNA, 19 nt, Artificial Sequence
  Synthetic
aagguuggaggggguggcg

SEQ ID NO: 10511 - RNA, 21 nt, Artificial Sequence
  Synthetic
acaagguuggaggggguggcg

SEQ ID NO: 10512 - RNA, 24 nt, Artificial Sequence
  Synthetic
uggacaagguuggaggggguggcg

SEQ ID NO: 10513 - RNA, 18 nt, Artificial Sequence
  Synthetic
aacugauuuauccuuggg

SEQ ID NO: 10514 - RNA, 19 nt, Artificial Sequence
  Synthetic
aaacugauuuauccuuggg

SEQ ID NO: 10515 - RNA, 20 nt, Artificial Sequence
  Synthetic
aaaacugauuuauccuuggg

SEQ ID NO: 10516 - RNA, 19 nt, Artificial Sequence
  Synthetic
ugcugccuuaagcuagugg

SEQ ID NO: 10517 - RNA, 20 nt, Artificial Sequence
  Synthetic
augcugccuuaagcuagugg

SEQ ID NO: 10518 - RNA, 21 nt, Artificial Sequence
  Synthetic
caugcugccuuaagcuagugg

SEQ ID NO: 10519 - RNA, 22 nt, Artificial Sequence
  Synthetic
ccaugcugccuuaagcuagugg

SEQ ID NO: 10520 - RNA, 24 nt, Artificial Sequence
  Synthetic
ugccaugcugccuuaagcuagugg

SEQ ID NO: 10521 - RNA, 18 nt, Artificial Sequence
  Synthetic
ccaguccagccgcaaccu

SEQ ID NO: 10522 - RNA, 19 nt, Artificial Sequence
  Synthetic
cccaguccagccgcaaccu

SEQ ID NO: 10523 - RNA, 22 nt, Artificial Sequence
  Synthetic
agucccaguccagccgcaaccu

SEQ ID NO: 10524 - RNA, 23 nt, Artificial Sequence
  Synthetic
cagucccaguccagccgcaaccu

SEQ ID NO: 10525 - RNA, 24 nt, Artificial Sequence
  Synthetic
ccagucccaguccagccgcaaccu

SEQ ID NO: 10526 - RNA, 18 nt, Artificial Sequence
  Synthetic
ugagggugaggcugaccu

SEQ ID NO: 10527 - RNA, 19 nt, Artificial Sequence
  Synthetic
cugagggugaggcugaccu

SEQ ID NO: 10528 - RNA, 20 nt, Artificial Sequence
  Synthetic
ccugagggugaggcugaccu

SEQ ID NO: 10529 - RNA, 24 nt, Artificial Sequence
  Synthetic
agggccugagggugaggcugaccu

SEQ ID NO: 10530 - RNA, 18 nt, Artificial Sequence
  Synthetic
cucuucucugcagggccu

SEQ ID NO: 10531 - RNA, 19 nt, Artificial Sequence
  Synthetic
ucucuucucugcagggccu

SEQ ID NO: 10532 - RNA, 20 nt, Artificial Sequence
  Synthetic
cucucuucucugcagggccu

SEQ ID NO: 10533 - RNA, 21 nt, Artificial Sequence
  Synthetic
ucucucuucucugcagggccu

SEQ ID NO: 10534 - RNA, 22 nt, Artificial Sequence
  Synthetic
uucucucuucucugcagggccu

SEQ ID NO: 10535 - RNA, 23 nt, Artificial Sequence
  Synthetic
cuucucucuucucugcagggccu

SEQ ID NO: 10536 - RNA, 24 nt, Artificial Sequence
  Synthetic
ucuucucucuucucugcagggccu

SEQ ID NO: 10537 - RNA, 18 nt, Artificial Sequence
  Synthetic
ccugccucuuccugggcu

SEQ ID NO: 10538 - RNA, 19 nt, Artificial Sequence
  Synthetic
cccugccucuuccugggcu

SEQ ID NO: 10539 - RNA, 20 nt, Artificial Sequence
  Synthetic
ucccugccucuuccugggcu

SEQ ID NO: 10540 - RNA, 18 nt, Artificial Sequence
  Synthetic
cccuccuagcugugggcu

SEQ ID NO: 10541 - RNA, 20 nt, Artificial Sequence
  Synthetic
ugcccuccuagcugugggcu

SEQ ID NO: 10542 - RNA, 18 nt, Artificial Sequence
  Synthetic
agggagacuggaguuucu

SEQ ID NO: 10543 - RNA, 19 nt, Artificial Sequence
  Synthetic
aagggagacuggaguuucu

SEQ ID NO: 10544 - RNA, 21 nt, Artificial Sequence
  Synthetic
ucaagggagacuggaguuucu

SEQ ID NO: 10545 - RNA, 22 nt, Artificial Sequence
  Synthetic
cucaagggagacuggaguuucu

SEQ ID NO: 10546 - RNA, 18 nt, Artificial Sequence
  Synthetic
aauccacgggcucugugu

SEQ ID NO: 10547 - RNA, 21 nt, Artificial Sequence
  Synthetic
acgaauccacgggcucugugu

SEQ ID NO: 10548 - RNA, 23 nt, Artificial Sequence
  Synthetic
agacgaauccacgggcucugugu

SEQ ID NO: 10549 - RNA, 24 nt, Artificial Sequence
  Synthetic
cagacgaauccacgggcucugugu

SEQ ID NO: 10550 - RNA, 19 nt, Artificial Sequence
  Synthetic
cgugcagggccuggguugu

SEQ ID NO: 10551 - RNA, 21 nt, Artificial Sequence
  Synthetic
cgcgugcagggccuggguugu

SEQ ID NO: 10552 - RNA, 22 nt, Artificial Sequence
  Synthetic
ccgcgugcagggccuggguugu

SEQ ID NO: 10553 - RNA, 24 nt, Artificial Sequence
  Synthetic
ugccgcgugcagggccuggguugu

SEQ ID NO: 10554 - RNA, 18 nt, Artificial Sequence
  Synthetic
agucuccuccagcccuuu

SEQ ID NO: 10555 - RNA, 20 nt, Artificial Sequence
  Synthetic
cgagucuccuccagcccuuu

SEQ ID NO: 10556 - RNA, 21 nt, Artificial Sequence
  Synthetic
ccgagucuccuccagcccuuu

SEQ ID NO: 10557 - RNA, 22 nt, Artificial Sequence
  Synthetic
cccgagucuccuccagcccuuu

SEQ ID NO: 10558 - RNA, 23 nt, Artificial Sequence
  Synthetic
ucccgagucuccuccagcccuuu

SEQ ID NO: 10559 - RNA, 24 nt, Artificial Sequence
  Synthetic
cucccgagucuccuccagcccuuu

SEQ ID NO: 10560 - RNA, 21 nt, Artificial Sequence
  Synthetic
auagaaggagccagcaccaaa

SEQ ID NO: 10561 - RNA, 22 nt, Artificial Sequence
  Synthetic
aauagaaggagccagcaccaaa

SEQ ID NO: 10562 - RNA, 23 nt, Artificial Sequence
  Synthetic
aaauagaaggagccagcaccaaa

SEQ ID NO: 10563 - RNA, 24 nt, Artificial Sequence
  Synthetic
caaauagaaggagccagcaccaaa

SEQ ID NO: 10564 - RNA, 18 nt, Artificial Sequence
  Synthetic
ccaaacuuaaugcagcaa

SEQ ID NO: 10565 - RNA, 19 nt, Artificial Sequence
  Synthetic
uccaaacuuaaugcagcaa

SEQ ID NO: 10566 - RNA, 20 nt, Artificial Sequence
  Synthetic
uuccaaacuuaaugcagcaa

SEQ ID NO: 10567 - RNA, 21 nt, Artificial Sequence
  Synthetic
gauagggauggaggaggggca

SEQ ID NO: 10568 - RNA, 22 nt, Artificial Sequence
  Synthetic
agauagggauggaggaggggca

SEQ ID NO: 10569 - RNA, 23 nt, Artificial Sequence
  Synthetic
gagauagggauggaggaggggca

SEQ ID NO: 10570 - RNA, 24 nt, Artificial Sequence
  Synthetic
agagauagggauggaggaggggca

SEQ ID NO: 10571 - RNA, 18 nt, Artificial Sequence
  Synthetic
ggagagagaggaggguca

SEQ ID NO: 10572 - RNA, 19 nt, Artificial Sequence
  Synthetic
aggagagagaggaggguca

SEQ ID NO: 10573 - RNA, 20 nt, Artificial Sequence
  Synthetic
aaggagagagaggaggguca

SEQ ID NO: 10574 - RNA, 21 nt, Artificial Sequence
  Synthetic
caaggagagagaggaggguca

SEQ ID NO: 10575 - RNA, 22 nt, Artificial Sequence
  Synthetic
gcaaggagagagaggaggguca

SEQ ID NO: 10576 - RNA, 23 nt, Artificial Sequence
  Synthetic
agcaaggagagagaggaggguca

SEQ ID NO: 10577 - RNA, 24 nt, Artificial Sequence
  Synthetic
gagcaaggagagagaggaggguca

SEQ ID NO: 10578 - RNA, 18 nt, Artificial Sequence
  Synthetic
ggcaaggaggcuggggga

SEQ ID NO: 10579 - RNA, 19 nt, Artificial Sequence
  Synthetic
aggcaaggaggcuggggga

SEQ ID NO: 10580 - RNA, 20 nt, Artificial Sequence
  Synthetic
caggcaaggaggcuggggga

SEQ ID NO: 10581 - RNA, 21 nt, Artificial Sequence
  Synthetic
acaggcaaggaggcuggggga

SEQ ID NO: 10582 - RNA, 22 nt, Artificial Sequence
  Synthetic
gacaggcaaggaggcuggggga

SEQ ID NO: 10583 - RNA, 23 nt, Artificial Sequence
  Synthetic
agacaggcaaggaggcuggggga

SEQ ID NO: 10584 - RNA, 24 nt, Artificial Sequence
  Synthetic
cagacaggcaaggaggcuggggga

SEQ ID NO: 10585 - RNA, 18 nt, Artificial Sequence
  Synthetic
auggaggaggggcacuga

SEQ ID NO: 10586 - RNA, 19 nt, Artificial Sequence
  Synthetic
gauggaggaggggcacuga

SEQ ID NO: 10587 - RNA, 20 nt, Artificial Sequence
  Synthetic
ggauggaggaggggcacuga

SEQ ID NO: 10588 - RNA, 21 nt, Artificial Sequence
  Synthetic
gggauggaggaggggcacuga

SEQ ID NO: 10589 - RNA, 22 nt, Artificial Sequence
  Synthetic
agggauggaggaggggcacuga

SEQ ID NO: 10590 - RNA, 23 nt, Artificial Sequence
  Synthetic
uagggauggaggaggggcacuga

SEQ ID NO: 10591 - RNA, 24 nt, Artificial Sequence
  Synthetic
auagggauggaggaggggcacuga

SEQ ID NO: 10592 - RNA, 21 nt, Artificial Sequence
  Synthetic
acuuaaugcagcaaaaggaua

SEQ ID NO: 10593 - RNA, 22 nt, Artificial Sequence
  Synthetic
aacuuaaugcagcaaaaggaua

SEQ ID NO: 10594 - RNA, 23 nt, Artificial Sequence
  Synthetic
aaacuuaaugcagcaaaaggaua

SEQ ID NO: 10595 - RNA, 24 nt, Artificial Sequence
  Synthetic
caaacuuaaugcagcaaaaggaua

SEQ ID NO: 10596 - RNA, 21 nt, Artificial Sequence
  Synthetic
ccucacucccacacagagccc

SEQ ID NO: 10597 - RNA, 22 nt, Artificial Sequence
  Synthetic
cccucacucccacacagagccc

SEQ ID NO: 10598 - RNA, 23 nt, Artificial Sequence
  Synthetic
ucccucacucccacacagagccc

SEQ ID NO: 10599 - RNA, 24 nt, Artificial Sequence
  Synthetic
cucccucacucccacacagagccc

SEQ ID NO: 10600 - RNA, 21 nt, Artificial Sequence
  Synthetic
ggcugaggaggagucagagcc

SEQ ID NO: 10601 - RNA, 22 nt, Artificial Sequence
  Synthetic
gggcugaggaggagucagagcc

SEQ ID NO: 10602 - RNA, 23 nt, Artificial Sequence
  Synthetic
ggggcugaggaggagucagagcc

SEQ ID NO: 10603 - RNA, 24 nt, Artificial Sequence
  Synthetic
aggggcugaggaggagucagagcc

SEQ ID NO: 10604 - RNA, 18 nt, Artificial Sequence
  Synthetic
cagccaggcugagagggc

SEQ ID NO: 10605 - RNA, 19 nt, Artificial Sequence
  Synthetic
ccagccaggcugagagggc

SEQ ID NO: 10606 - RNA, 20 nt, Artificial Sequence
  Synthetic
gccagccaggcugagagggc

SEQ ID NO: 10607 - RNA, 21 nt, Artificial Sequence
  Synthetic
ggccagccaggcugagagggc

SEQ ID NO: 10608 - RNA, 22 nt, Artificial Sequence
  Synthetic
gggccagccaggcugagagggc

SEQ ID NO: 10609 - RNA, 23 nt, Artificial Sequence
  Synthetic
ggggccagccaggcugagagggc

SEQ ID NO: 10610 - RNA, 24 nt, Artificial Sequence
  Synthetic
aggggccagccaggcugagagggc

SEQ ID NO: 10611 - RNA, 21 nt, Artificial Sequence
  Synthetic
uccuggagccagcagaccugc

SEQ ID NO: 10612 - RNA, 22 nt, Artificial Sequence
  Synthetic
uuccuggagccagcagaccugc

SEQ ID NO: 10613 - RNA, 23 nt, Artificial Sequence
  Synthetic
uuuccuggagccagcagaccugc

SEQ ID NO: 10614 - RNA, 24 nt, Artificial Sequence
  Synthetic
cuuuccuggagccagcagaccugc

SEQ ID NO: 10615 - RNA, 21 nt, Artificial Sequence
  Synthetic
cuuccuuuggucuucuuccuc

SEQ ID NO: 10616 - RNA, 22 nt, Artificial Sequence
  Synthetic
ccuuccuuuggucuucuuccuc

SEQ ID NO: 10617 - RNA, 23 nt, Artificial Sequence
  Synthetic
cccuuccuuuggucuucuuccuc

SEQ ID NO: 10618 - RNA, 24 nt, Artificial Sequence
  Synthetic
ccccuuccuuuggucuucuuccuc

SEQ ID NO: 10619 - RNA, 18 nt, Artificial Sequence
  Synthetic
gugagcaaggagagagag

SEQ ID NO: 10620 - RNA, 19 nt, Artificial Sequence
  Synthetic
ggugagcaaggagagagag

SEQ ID NO: 10621 - RNA, 20 nt, Artificial Sequence
  Synthetic
uggugagcaaggagagagag

SEQ ID NO: 10622 - RNA, 21 nt, Artificial Sequence
  Synthetic
guggugagcaaggagagagag

SEQ ID NO: 10623 - RNA, 22 nt, Artificial Sequence
  Synthetic
aguggugagcaaggagagagag

SEQ ID NO: 10624 - RNA, 23 nt, Artificial Sequence
  Synthetic
aaguggugagcaaggagagagag

SEQ ID NO: 10625 - RNA, 24 nt, Artificial Sequence
  Synthetic
caaguggugagcaaggagagagag

SEQ ID NO: 10626 - RNA, 18 nt, Artificial Sequence
  Synthetic
aaagaucugaacaaguag

SEQ ID NO: 10627 - RNA, 19 nt, Artificial Sequence
  Synthetic
caaagaucugaacaaguag

SEQ ID NO: 10628 - RNA, 20 nt, Artificial Sequence
  Synthetic
gcaaagaucugaacaaguag

SEQ ID NO: 10629 - RNA, 21 nt, Artificial Sequence
  Synthetic
agcaggcacugaaggugcagg

SEQ ID NO: 10630 - RNA, 22 nt, Artificial Sequence
  Synthetic
aagcaggcacugaaggugcagg

SEQ ID NO: 10631 - RNA, 23 nt, Artificial Sequence
  Synthetic
aaagcaggcacugaaggugcagg

SEQ ID NO: 10632 - RNA, 24 nt, Artificial Sequence
  Synthetic
gaaagcaggcacugaaggugcagg

SEQ ID NO: 10633 - RNA, 18 nt, Artificial Sequence
  Synthetic
cggggggaggggcugagg

SEQ ID NO: 10634 - RNA, 19 nt, Artificial Sequence
  Synthetic
gcggggggaggggcugagg

SEQ ID NO: 10635 - RNA, 21 nt, Artificial Sequence
  Synthetic
gggcggggggaggggcugagg

SEQ ID NO: 10636 - RNA, 22 nt, Artificial Sequence
  Synthetic
agggcggggggaggggcugagg

SEQ ID NO: 10637 - RNA, 23 nt, Artificial Sequence
  Synthetic
cagggcggggggaggggcugagg

SEQ ID NO: 10638 - RNA, 24 nt, Artificial Sequence
  Synthetic
gcagggcggggggaggggcugagg

SEQ ID NO: 10639 - RNA, 21 nt, Artificial Sequence
  Synthetic
cuccaggaaggagagcaaggg

SEQ ID NO: 10640 - RNA, 22 nt, Artificial Sequence
  Synthetic
ucuccaggaaggagagcaaggg

SEQ ID NO: 10641 - RNA, 23 nt, Artificial Sequence
  Synthetic
gucuccaggaaggagagcaaggg

SEQ ID NO: 10642 - RNA, 24 nt, Artificial Sequence
  Synthetic
ugucuccaggaaggagagcaaggg

SEQ ID NO: 10643 - RNA, 18 nt, Artificial Sequence
  Synthetic
gagaaggugucaucucug

SEQ ID NO: 10644 - RNA, 19 nt, Artificial Sequence
  Synthetic
agagaaggugucaucucug

SEQ ID NO: 10645 - RNA, 20 nt, Artificial Sequence
  Synthetic
cagagaaggugucaucucug

SEQ ID NO: 10646 - RNA, 21 nt, Artificial Sequence
  Synthetic
ccagagaaggugucaucucug

SEQ ID NO: 10647 - RNA, 22 nt, Artificial Sequence
  Synthetic
cccagagaaggugucaucucug

SEQ ID NO: 10648 - RNA, 23 nt, Artificial Sequence
  Synthetic
ucccagagaaggugucaucucug

SEQ ID NO: 10649 - RNA, 24 nt, Artificial Sequence
  Synthetic
uucccagagaaggugucaucucug

SEQ ID NO: 10650 - RNA, 21 nt, Artificial Sequence
  Synthetic
gacagcgaaggacagagagau

SEQ ID NO: 10651 - RNA, 22 nt, Artificial Sequence
  Synthetic
ggacagcgaaggacagagagau

SEQ ID NO: 10652 - RNA, 23 nt, Artificial Sequence
  Synthetic
gggacagcgaaggacagagagau

SEQ ID NO: 10653 - RNA, 24 nt, Artificial Sequence
  Synthetic
agggacagcgaaggacagagagau

SEQ ID NO: 10654 - RNA, 21 nt, Artificial Sequence
  Synthetic
gcucccgagggcaggugaacu

SEQ ID NO: 10655 - RNA, 22 nt, Artificial Sequence
  Synthetic
ggcucccgagggcaggugaacu

SEQ ID NO: 10656 - RNA, 23 nt, Artificial Sequence
  Synthetic
gggcucccgagggcaggugaacu

SEQ ID NO: 10657 - RNA, 24 nt, Artificial Sequence
  Synthetic
agggcucccgagggcaggugaacu

SEQ ID NO: 10658 - RNA, 21 nt, Artificial Sequence
  Synthetic
gaaaaggcaguacuccaggcu

SEQ ID NO: 10659 - RNA, 22 nt, Artificial Sequence
  Synthetic
agaaaaggcaguacuccaggcu

SEQ ID NO: 10660 - RNA, 23 nt, Artificial Sequence
  Synthetic
gagaaaaggcaguacuccaggcu

SEQ ID NO: 10661 - RNA, 24 nt, Artificial Sequence
  Synthetic
agagaaaaggcaguacuccaggcu

SEQ ID NO: 10662 - RNA, 18 nt, Artificial Sequence
  Synthetic
cccugauagggccaccuu

SEQ ID NO: 10663 - RNA, 19 nt, Artificial Sequence
  Synthetic
ucccugauagggccaccuu

SEQ ID NO: 10664 - RNA, 20 nt, Artificial Sequence
  Synthetic
uucccugauagggccaccuu

SEQ ID NO: 10665 - RNA, 21 nt, Artificial Sequence
  Synthetic
uggagaaaauauagcccauca

SEQ ID NO: 10666 - RNA, 22 nt, Artificial Sequence
  Synthetic
uuggagaaaauauagcccauca

SEQ ID NO: 10667 - RNA, 23 nt, Artificial Sequence
  Synthetic
uuuggagaaaauauagcccauca

SEQ ID NO: 10668 - RNA, 24 nt, Artificial Sequence
  Synthetic
uuuuggagaaaauauagcccauca

SEQ ID NO: 10669 - RNA, 21 nt, Artificial Sequence
  Synthetic
ccugcaguccuggggcagaga

SEQ ID NO: 10670 - RNA, 22 nt, Artificial Sequence
  Synthetic
cccugcaguccuggggcagaga

SEQ ID NO: 10671 - RNA, 23 nt, Artificial Sequence
  Synthetic
gcccugcaguccuggggcagaga

SEQ ID NO: 10672 - RNA, 24 nt, Artificial Sequence
  Synthetic
agcccugcaguccuggggcagaga

SEQ ID NO: 10673 - RNA, 18 nt, Artificial Sequence
  Synthetic
acagaaggcagauagaga

SEQ ID NO: 10674 - RNA, 19 nt, Artificial Sequence
  Synthetic
aacagaaggcagauagaga

SEQ ID NO: 10675 - RNA, 21 nt, Artificial Sequence
  Synthetic
gaaacagaaggcagauagaga

SEQ ID NO: 10676 - RNA, 22 nt, Artificial Sequence
  Synthetic
agaaacagaaggcagauagaga

SEQ ID NO: 10677 - RNA, 23 nt, Artificial Sequence
  Synthetic
gagaaacagaaggcagauagaga

SEQ ID NO: 10678 - RNA, 24 nt, Artificial Sequence
  Synthetic
agagaaacagaaggcagauagaga

SEQ ID NO: 10679 - RNA, 21 nt, Artificial Sequence
  Synthetic
aggaccuggcucaagggagac

SEQ ID NO: 10680 - RNA, 22 nt, Artificial Sequence
  Synthetic
aaggaccuggcucaagggagac

SEQ ID NO: 10681 - RNA, 23 nt, Artificial Sequence
  Synthetic
uaaggaccuggcucaagggagac

SEQ ID NO: 10682 - RNA, 24 nt, Artificial Sequence
  Synthetic
guaaggaccuggcucaagggagac

SEQ ID NO: 10683 - RNA, 18 nt, Artificial Sequence
  Synthetic
aggcuggagcugagggcc

SEQ ID NO: 10684 - RNA, 19 nt, Artificial Sequence
  Synthetic
gaggcuggagcugagggcc

SEQ ID NO: 10685 - RNA, 20 nt, Artificial Sequence
  Synthetic
agaggcuggagcugagggcc

SEQ ID NO: 10686 - RNA, 21 nt, Artificial Sequence
  Synthetic
cagaggcuggagcugagggcc

SEQ ID NO: 10687 - RNA, 22 nt, Artificial Sequence
  Synthetic
ccagaggcuggagcugagggcc

SEQ ID NO: 10688 - RNA, 23 nt, Artificial Sequence
  Synthetic
gccagaggcuggagcugagggcc

SEQ ID NO: 10689 - RNA, 24 nt, Artificial Sequence
  Synthetic
ggccagaggcuggagcugagggcc

SEQ ID NO: 10690 - RNA, 21 nt, Artificial Sequence
  Synthetic
uggguuguguggguggcucuc

SEQ ID NO: 10691 - RNA, 22 nt, Artificial Sequence
  Synthetic
cuggguuguguggguggcucuc

SEQ ID NO: 10692 - RNA, 23 nt, Artificial Sequence
  Synthetic
ccuggguuguguggguggcucuc

SEQ ID NO: 10693 - RNA, 24 nt, Artificial Sequence
  Synthetic
gccuggguuguguggguggcucuc

SEQ ID NO: 10694 - RNA, 18 nt, Artificial Sequence
  Synthetic
cuucucugggaaggcuuc

SEQ ID NO: 10695 - RNA, 19 nt, Artificial Sequence
  Synthetic
ccuucucugggaaggcuuc

SEQ ID NO: 10696 - RNA, 20 nt, Artificial Sequence
  Synthetic
accuucucugggaaggcuuc

SEQ ID NO: 10697 - RNA, 21 nt, Artificial Sequence
  Synthetic
caccuucucugggaaggcuuc

SEQ ID NO: 10698 - RNA, 22 nt, Artificial Sequence
  Synthetic
acaccuucucugggaaggcuuc

SEQ ID NO: 10699 - RNA, 23 nt, Artificial Sequence
  Synthetic
gacaccuucucugggaaggcuuc

SEQ ID NO: 10700 - RNA, 24 nt, Artificial Sequence
  Synthetic
ugacaccuucucugggaaggcuuc

SEQ ID NO: 10701 - RNA, 21 nt, Artificial Sequence
  Synthetic
aggagugggagaaugugggcg

SEQ ID NO: 10702 - RNA, 22 nt, Artificial Sequence
  Synthetic
gaggagugggagaaugugggcg

SEQ ID NO: 10703 - RNA, 23 nt, Artificial Sequence
  Synthetic
ggaggagugggagaaugugggcg

SEQ ID NO: 10704 - RNA, 24 nt, Artificial Sequence
  Synthetic
gggaggagugggagaaugugggcg

SEQ ID NO: 10705 - RNA, 18 nt, Artificial Sequence
  Synthetic
gggggagaggaagagagg

SEQ ID NO: 10706 - RNA, 19 nt, Artificial Sequence
  Synthetic
ggggggagaggaagagagg

SEQ ID NO: 10707 - RNA, 20 nt, Artificial Sequence
  Synthetic
gggggggagaggaagagagg

SEQ ID NO: 10708 - RNA, 21 nt, Artificial Sequence
  Synthetic
agggggggagaggaagagagg

SEQ ID NO: 10709 - RNA, 22 nt, Artificial Sequence
  Synthetic
aagggggggagaggaagagagg

SEQ ID NO: 10710 - RNA, 23 nt, Artificial Sequence
  Synthetic
caagggggggagaggaagagagg

SEQ ID NO: 10711 - RNA, 24 nt, Artificial Sequence
  Synthetic
gcaagggggggagaggaagagagg

SEQ ID NO: 10712 - RNA, 18 nt, Artificial Sequence
  Synthetic
aagguggaggagggaggg

SEQ ID NO: 10713 - RNA, 19 nt, Artificial Sequence
  Synthetic
aaagguggaggagggaggg

SEQ ID NO: 10714 - RNA, 21 nt, Artificial Sequence
  Synthetic
ggaaagguggaggagggaggg

SEQ ID NO: 10715 - RNA, 22 nt, Artificial Sequence
  Synthetic
aggaaagguggaggagggaggg

SEQ ID NO: 10716 - RNA, 23 nt, Artificial Sequence
  Synthetic
caggaaagguggaggagggaggg

SEQ ID NO: 10717 - RNA, 24 nt, Artificial Sequence
  Synthetic
ccaggaaagguggaggagggaggg

SEQ ID NO: 10718 - RNA, 21 nt, Artificial Sequence
  Synthetic
gaaaacugauuuauccuuggg

SEQ ID NO: 10719 - RNA, 22 nt, Artificial Sequence
  Synthetic
agaaaacugauuuauccuuggg

SEQ ID NO: 10720 - RNA, 23 nt, Artificial Sequence
  Synthetic
cagaaaacugauuuauccuuggg

SEQ ID NO: 10721 - RNA, 24 nt, Artificial Sequence
  Synthetic
ucagaaaacugauuuauccuuggg

SEQ ID NO: 10722 - RNA, 18 nt, Artificial Sequence
  Synthetic
ggagggagggaggagugg

SEQ ID NO: 10723 - RNA, 19 nt, Artificial Sequence
  Synthetic
aggagggagggaggagugg

SEQ ID NO: 10724 - RNA, 20 nt, Artificial Sequence
  Synthetic
gaggagggagggaggagugg

SEQ ID NO: 10725 - RNA, 21 nt, Artificial Sequence
  Synthetic
ggaggagggagggaggagugg

SEQ ID NO: 10726 - RNA, 22 nt, Artificial Sequence
  Synthetic
uggaggagggagggaggagugg

SEQ ID NO: 10727 - RNA, 23 nt, Artificial Sequence
  Synthetic
guggaggagggagggaggagugg

SEQ ID NO: 10728 - RNA, 24 nt, Artificial Sequence
  Synthetic
gguggaggagggagggaggagugg

SEQ ID NO: 10729 - RNA, 21 nt, Artificial Sequence
  Synthetic
uucccugccucuuccugggcu

SEQ ID NO: 10730 - RNA, 22 nt, Artificial Sequence
  Synthetic
uuucccugccucuuccugggcu

SEQ ID NO: 10731 - RNA, 23 nt, Artificial Sequence
  Synthetic
cuuucccugccucuuccugggcu

SEQ ID NO: 10732 - RNA, 24 nt, Artificial Sequence
  Synthetic
gcuuucccugccucuuccugggcu

SEQ ID NO: 10733 - RNA, 21 nt, Artificial Sequence
  Synthetic
uugcccuccuagcugugggcu

SEQ ID NO: 10734 - RNA, 22 nt, Artificial Sequence
  Synthetic
guugcccuccuagcugugggcu

SEQ ID NO: 10735 - RNA, 23 nt, Artificial Sequence
  Synthetic
uguugcccuccuagcugugggcu

SEQ ID NO: 10736 - RNA, 24 nt, Artificial Sequence
  Synthetic
guguugcccuccuagcugugggcu

SEQ ID NO: 10737 - RNA, 18 nt, Artificial Sequence
  Synthetic
cagaggaggaggagaauu

SEQ ID NO: 10738 - RNA, 19 nt, Artificial Sequence
  Synthetic
ccagaggaggaggagaauu

SEQ ID NO: 10739 - RNA, 20 nt, Artificial Sequence
  Synthetic
cccagaggaggaggagaauu

SEQ ID NO: 10740 - RNA, 21 nt, Artificial Sequence
  Synthetic
ccccagaggaggaggagaauu

SEQ ID NO: 10741 - RNA, 22 nt, Artificial Sequence
  Synthetic
gccccagaggaggaggagaauu

SEQ ID NO: 10742 - RNA, 23 nt, Artificial Sequence
  Synthetic
agccccagaggaggaggagaauu

SEQ ID NO: 10743 - RNA, 24 nt, Artificial Sequence
  Synthetic
uagccccagaggaggaggagaauu

SEQ ID NO: 10744 - RNA, 18 nt, Artificial Sequence
  Synthetic
ugagguuagaaaacaaaa

SEQ ID NO: 10745 - RNA, 19 nt, Artificial Sequence
  Synthetic
cugagguuagaaaacaaaa

SEQ ID NO: 10746 - RNA, 20 nt, Artificial Sequence
  Synthetic
ucugagguuagaaaacaaaa

SEQ ID NO: 10747 - RNA, 21 nt, Artificial Sequence
  Synthetic
uucugagguuagaaaacaaaa

SEQ ID NO: 10748 - RNA, 22 nt, Artificial Sequence
  Synthetic
uuucugagguuagaaaacaaaa

SEQ ID NO: 10749 - RNA, 23 nt, Artificial Sequence
  Synthetic
uuuucugagguuagaaaacaaaa

SEQ ID NO: 10750 - RNA, 24 nt, Artificial Sequence
  Synthetic
guuuucugagguuagaaaacaaaa

SEQ ID NO: 10751 - RNA, 18 nt, Artificial Sequence
  Synthetic
cagagaaucagacccaaa

SEQ ID NO: 10752 - RNA, 19 nt, Artificial Sequence
  Synthetic
ucagagaaucagacccaaa

SEQ ID NO: 10753 - RNA, 20 nt, Artificial Sequence
  Synthetic
gucagagaaucagacccaaa

SEQ ID NO: 10754 - RNA, 21 nt, Artificial Sequence
  Synthetic
ggucagagaaucagacccaaa

SEQ ID NO: 10755 - RNA, 22 nt, Artificial Sequence
  Synthetic
gggucagagaaucagacccaaa

SEQ ID NO: 10756 - RNA, 23 nt, Artificial Sequence
  Synthetic
agggucagagaaucagacccaaa

SEQ ID NO: 10757 - RNA, 24 nt, Artificial Sequence
  Synthetic
gagggucagagaaucagacccaaa

SEQ ID NO: 10758 - RNA, 18 nt, Artificial Sequence
  Synthetic
ggcaguggugggggcaaa

SEQ ID NO: 10759 - RNA, 19 nt, Artificial Sequence
  Synthetic
gggcaguggugggggcaaa

SEQ ID NO: 10760 - RNA, 20 nt, Artificial Sequence
  Synthetic
ggggcaguggugggggcaaa

SEQ ID NO: 10761 - RNA, 21 nt, Artificial Sequence
  Synthetic
gggggcaguggugggggcaaa

SEQ ID NO: 10762 - RNA, 22 nt, Artificial Sequence
  Synthetic
ggggggcaguggugggggcaaa

SEQ ID NO: 10763 - RNA, 23 nt, Artificial Sequence
  Synthetic
uggggggcaguggugggggcaaa

SEQ ID NO: 10764 - RNA, 24 nt, Artificial Sequence
  Synthetic
guggggggcaguggugggggcaaa

SEQ ID NO: 10765 - RNA, 18 nt, Artificial Sequence
  Synthetic
aggacaggagggcagaaa

SEQ ID NO: 10766 - RNA, 19 nt, Artificial Sequence
  Synthetic
gaggacaggagggcagaaa

SEQ ID NO: 10767 - RNA, 20 nt, Artificial Sequence
  Synthetic
ggaggacaggagggcagaaa

SEQ ID NO: 10768 - RNA, 21 nt, Artificial Sequence
  Synthetic
gggaggacaggagggcagaaa

SEQ ID NO: 10769 - RNA, 22 nt, Artificial Sequence
  Synthetic
cgggaggacaggagggcagaaa

SEQ ID NO: 10770 - RNA, 23 nt, Artificial Sequence
  Synthetic
ccgggaggacaggagggcagaaa

SEQ ID NO: 10771 - RNA, 24 nt, Artificial Sequence
  Synthetic
accgggaggacaggagggcagaaa

SEQ ID NO: 10772 - RNA, 18 nt, Artificial Sequence
  Synthetic
cucuugcgacuucuuaaa

SEQ ID NO: 10773 - RNA, 19 nt, Artificial Sequence
  Synthetic
ucucuugcgacuucuuaaa

SEQ ID NO: 10774 - RNA, 20 nt, Artificial Sequence
  Synthetic
gucucuugcgacuucuuaaa

SEQ ID NO: 10775 - RNA, 21 nt, Artificial Sequence
  Synthetic
agucucuugcgacuucuuaaa

SEQ ID NO: 10776 - RNA, 22 nt, Artificial Sequence
  Synthetic
cagucucuugcgacuucuuaaa

SEQ ID NO: 10777 - RNA, 23 nt, Artificial Sequence
  Synthetic
gcagucucuugcgacuucuuaaa

SEQ ID NO: 10778 - RNA, 24 nt, Artificial Sequence
  Synthetic
ggcagucucuugcgacuucuuaaa

SEQ ID NO: 10779 - RNA, 18 nt, Artificial Sequence
  Synthetic
uaaaagauugucuuuaaa

SEQ ID NO: 10780 - RNA, 19 nt, Artificial Sequence
  Synthetic
uuaaaagauugucuuuaaa

SEQ ID NO: 10781 - RNA, 20 nt, Artificial Sequence
  Synthetic
uuuaaaagauugucuuuaaa

SEQ ID NO: 10782 - RNA, 21 nt, Artificial Sequence
  Synthetic
cuuuaaaagauugucuuuaaa

SEQ ID NO: 10783 - RNA, 22 nt, Artificial Sequence
  Synthetic
acuuuaaaagauugucuuuaaa

SEQ ID NO: 10784 - RNA, 23 nt, Artificial Sequence
  Synthetic
cacuuuaaaagauugucuuuaaa

SEQ ID NO: 10785 - RNA, 24 nt, Artificial Sequence
  Synthetic
acacuuuaaaagauugucuuuaaa

SEQ ID NO: 10786 - RNA, 18 nt, Artificial Sequence
  Synthetic
gcagaaagagggagacaa

SEQ ID NO: 10787 - RNA, 19 nt, Artificial Sequence
  Synthetic
ggcagaaagagggagacaa

SEQ ID NO: 10788 - RNA, 20 nt, Artificial Sequence
  Synthetic
gggcagaaagagggagacaa

SEQ ID NO: 10789 - RNA, 21 nt, Artificial Sequence
  Synthetic
agggcagaaagagggagacaa

SEQ ID NO: 10790 - RNA, 22 nt, Artificial Sequence
  Synthetic
gagggcagaaagagggagacaa

SEQ ID NO: 10791 - RNA, 23 nt, Artificial Sequence
  Synthetic
ggagggcagaaagagggagacaa

SEQ ID NO: 10792 - RNA, 24 nt, Artificial Sequence
  Synthetic
aggagggcagaaagagggagacaa

SEQ ID NO: 10793 - RNA, 18 nt, Artificial Sequence
  Synthetic
agaaggagccagcaccaa

SEQ ID NO: 10794 - RNA, 19 nt, Artificial Sequence
  Synthetic
uagaaggagccagcaccaa

SEQ ID NO: 10795 - RNA, 21 nt, Artificial Sequence
  Synthetic
aauagaaggagccagcaccaa

SEQ ID NO: 10796 - RNA, 22 nt, Artificial Sequence
  Synthetic
aaauagaaggagccagcaccaa

SEQ ID NO: 10797 - RNA, 23 nt, Artificial Sequence
  Synthetic
caaauagaaggagccagcaccaa

SEQ ID NO: 10798 - RNA, 24 nt, Artificial Sequence
  Synthetic
gcaaauagaaggagccagcaccaa

SEQ ID NO: 10799 - RNA, 18 nt, Artificial Sequence
  Synthetic
gagcuagaggcucagcaa

SEQ ID NO: 10800 - RNA, 19 nt, Artificial Sequence
  Synthetic
ggagcuagaggcucagcaa

SEQ ID NO: 10801 - RNA, 20 nt, Artificial Sequence
  Synthetic
aggagcuagaggcucagcaa

SEQ ID NO: 10802 - RNA, 21 nt, Artificial Sequence
  Synthetic
caggagcuagaggcucagcaa

SEQ ID NO: 10803 - RNA, 22 nt, Artificial Sequence
  Synthetic
ccaggagcuagaggcucagcaa

SEQ ID NO: 10804 - RNA, 23 nt, Artificial Sequence
  Synthetic
uccaggagcuagaggcucagcaa

SEQ ID NO: 10805 - RNA, 24 nt, Artificial Sequence
  Synthetic
uuccaggagcuagaggcucagcaa

SEQ ID NO: 10806 - RNA, 18 nt, Artificial Sequence
  Synthetic
cuccaggaaggagagcaa

SEQ ID NO: 10807 - RNA, 19 nt, Artificial Sequence
  Synthetic
ucuccaggaaggagagcaa

SEQ ID NO: 10808 - RNA, 21 nt, Artificial Sequence
  Synthetic
ugucuccaggaaggagagcaa

SEQ ID NO: 10809 - RNA, 22 nt, Artificial Sequence
  Synthetic
cugucuccaggaaggagagcaa

SEQ ID NO: 10810 - RNA, 23 nt, Artificial Sequence
  Synthetic
ucugucuccaggaaggagagcaa

SEQ ID NO: 10811 - RNA, 24 nt, Artificial Sequence
  Synthetic
gucugucuccaggaaggagagcaa

SEQ ID NO: 10812 - RNA, 18 nt, Artificial Sequence
  Synthetic
aguuuagcaggcaaagaa

SEQ ID NO: 10813 - RNA, 19 nt, Artificial Sequence
  Synthetic
gaguuuagcaggcaaagaa

SEQ ID NO: 10814 - RNA, 20 nt, Artificial Sequence
  Synthetic
ggaguuuagcaggcaaagaa

SEQ ID NO: 10815 - RNA, 21 nt, Artificial Sequence
  Synthetic
aggaguuuagcaggcaaagaa

SEQ ID NO: 10816 - RNA, 22 nt, Artificial Sequence
  Synthetic
aaggaguuuagcaggcaaagaa

SEQ ID NO: 10817 - RNA, 23 nt, Artificial Sequence
  Synthetic
caaggaguuuagcaggcaaagaa

SEQ ID NO: 10818 - RNA, 24 nt, Artificial Sequence
  Synthetic
gcaaggaguuuagcaggcaaagaa

SEQ ID NO: 10819 - RNA, 18 nt, Artificial Sequence
  Synthetic
cucaggcccugcagagaa

SEQ ID NO: 10820 - RNA, 19 nt, Artificial Sequence
  Synthetic
ccucaggcccugcagagaa

SEQ ID NO: 10821 - RNA, 20 nt, Artificial Sequence
  Synthetic
cccucaggcccugcagagaa

SEQ ID NO: 10822 - RNA, 21 nt, Artificial Sequence
  Synthetic
acccucaggcccugcagagaa

SEQ ID NO: 10823 - RNA, 22 nt, Artificial Sequence
  Synthetic
cacccucaggcccugcagagaa

SEQ ID NO: 10824 - RNA, 23 nt, Artificial Sequence
  Synthetic
ucacccucaggcccugcagagaa

SEQ ID NO: 10825 - RNA, 24 nt, Artificial Sequence
  Synthetic
cucacccucaggcccugcagagaa

SEQ ID NO: 10826 - RNA, 18 nt, Artificial Sequence
  Synthetic
gagggccuggguggggaa

SEQ ID NO: 10827 - RNA, 19 nt, Artificial Sequence
  Synthetic
agagggccuggguggggaa

SEQ ID NO: 10828 - RNA, 20 nt, Artificial Sequence
  Synthetic
gagagggccuggguggggaa

SEQ ID NO: 10829 - RNA, 21 nt, Artificial Sequence
  Synthetic
ugagagggccuggguggggaa

SEQ ID NO: 10830 - RNA, 22 nt, Artificial Sequence
  Synthetic
cugagagggccuggguggggaa

SEQ ID NO: 10831 - RNA, 23 nt, Artificial Sequence
  Synthetic
gcugagagggccuggguggggaa

SEQ ID NO: 10832 - RNA, 24 nt, Artificial Sequence
  Synthetic
ggcugagagggccuggguggggaa

SEQ ID NO: 10833 - RNA, 18 nt, Artificial Sequence
  Synthetic
auguggccagcgcuggaa

SEQ ID NO: 10834 - RNA, 19 nt, Artificial Sequence
  Synthetic
gauguggccagcgcuggaa

SEQ ID NO: 10835 - RNA, 21 nt, Artificial Sequence
  Synthetic
aggauguggccagcgcuggaa

SEQ ID NO: 10836 - RNA, 22 nt, Artificial Sequence
  Synthetic
gaggauguggccagcgcuggaa

SEQ ID NO: 10837 - RNA, 23 nt, Artificial Sequence
  Synthetic
ggaggauguggccagcgcuggaa

SEQ ID NO: 10838 - RNA, 24 nt, Artificial Sequence
  Synthetic
gggaggauguggccagcgcuggaa

SEQ ID NO: 10839 - RNA, 18 nt, Artificial Sequence
  Synthetic
cucccgagggcaggugaa

SEQ ID NO: 10840 - RNA, 19 nt, Artificial Sequence
  Synthetic
gcucccgagggcaggugaa

SEQ ID NO: 10841 - RNA, 20 nt, Artificial Sequence
  Synthetic
ggcucccgagggcaggugaa

SEQ ID NO: 10842 - RNA, 21 nt, Artificial Sequence
  Synthetic
gggcucccgagggcaggugaa

SEQ ID NO: 10843 - RNA, 22 nt, Artificial Sequence
  Synthetic
agggcucccgagggcaggugaa

SEQ ID NO: 10844 - RNA, 23 nt, Artificial Sequence
  Synthetic
gagggcucccgagggcaggugaa

SEQ ID NO: 10845 - RNA, 24 nt, Artificial Sequence
  Synthetic
ggagggcucccgagggcaggugaa

SEQ ID NO: 10846 - RNA, 18 nt, Artificial Sequence
  Synthetic
cuccuccccgcucacuaa

SEQ ID NO: 10847 - RNA, 19 nt, Artificial Sequence
  Synthetic
ucuccuccccgcucacuaa

SEQ ID NO: 10848 - RNA, 20 nt, Artificial Sequence
  Synthetic
gucuccuccccgcucacuaa

SEQ ID NO: 10849 - RNA, 21 nt, Artificial Sequence
  Synthetic
ggucuccuccccgcucacuaa

SEQ ID NO: 10850 - RNA, 22 nt, Artificial Sequence
  Synthetic
aggucuccuccccgcucacuaa

SEQ ID NO: 10851 - RNA, 23 nt, Artificial Sequence
  Synthetic
caggucuccuccccgcucacuaa

SEQ ID NO: 10852 - RNA, 24 nt, Artificial Sequence
  Synthetic
gcaggucuccuccccgcucacuaa

SEQ ID NO: 10853 - RNA, 18 nt, Artificial Sequence
  Synthetic
agcuaggagggcaacaca

SEQ ID NO: 10854 - RNA, 19 nt, Artificial Sequence
  Synthetic
cagcuaggagggcaacaca

SEQ ID NO: 10855 - RNA, 21 nt, Artificial Sequence
  Synthetic
cacagcuaggagggcaacaca

SEQ ID NO: 10856 - RNA, 22 nt, Artificial Sequence
  Synthetic
ccacagcuaggagggcaacaca

SEQ ID NO: 10857 - RNA, 23 nt, Artificial Sequence
  Synthetic
cccacagcuaggagggcaacaca

SEQ ID NO: 10858 - RNA, 24 nt, Artificial Sequence
  Synthetic
gcccacagcuaggagggcaacaca

SEQ ID NO: 10859 - RNA, 18 nt, Artificial Sequence
  Synthetic
ccugagcauugauacaca

SEQ ID NO: 10860 - RNA, 19 nt, Artificial Sequence
  Synthetic
gccugagcauugauacaca

SEQ ID NO: 10861 - RNA, 20 nt, Artificial Sequence
  Synthetic
agccugagcauugauacaca

SEQ ID NO: 10862 - RNA, 21 nt, Artificial Sequence
  Synthetic
cagccugagcauugauacaca

SEQ ID NO: 10863 - RNA, 22 nt, Artificial Sequence
  Synthetic
ccagccugagcauugauacaca

SEQ ID NO: 10864 - RNA, 23 nt, Artificial Sequence
  Synthetic
cccagccugagcauugauacaca

SEQ ID NO: 10865 - RNA, 24 nt, Artificial Sequence
  Synthetic
gcccagccugagcauugauacaca

SEQ ID NO: 10866 - RNA, 18 nt, Artificial Sequence
  Synthetic
gccucccucacucccaca

SEQ ID NO: 10867 - RNA, 19 nt, Artificial Sequence
  Synthetic
ggccucccucacucccaca

SEQ ID NO: 10868 - RNA, 20 nt, Artificial Sequence
  Synthetic
aggccucccucacucccaca

SEQ ID NO: 10869 - RNA, 21 nt, Artificial Sequence
  Synthetic
aaggccucccucacucccaca

SEQ ID NO: 10870 - RNA, 22 nt, Artificial Sequence
  Synthetic
gaaggccucccucacucccaca

SEQ ID NO: 10871 - RNA, 23 nt, Artificial Sequence
  Synthetic
ggaaggccucccucacucccaca

SEQ ID NO: 10872 - RNA, 24 nt, Artificial Sequence
  Synthetic
gggaaggccucccucacucccaca

SEQ ID NO: 10873 - RNA, 18 nt, Artificial Sequence
  Synthetic
gagggacagcgaaggaca

SEQ ID NO: 10874 - RNA, 19 nt, Artificial Sequence
  Synthetic
agagggacagcgaaggaca

SEQ ID NO: 10875 - RNA, 20 nt, Artificial Sequence
  Synthetic
gagagggacagcgaaggaca

SEQ ID NO: 10876 - RNA, 21 nt, Artificial Sequence
  Synthetic
agagagggacagcgaaggaca

SEQ ID NO: 10877 - RNA, 22 nt, Artificial Sequence
  Synthetic
uagagagggacagcgaaggaca

SEQ ID NO: 10878 - RNA, 23 nt, Artificial Sequence
  Synthetic
auagagagggacagcgaaggaca

SEQ ID NO: 10879 - RNA, 24 nt, Artificial Sequence
  Synthetic
aauagagagggacagcgaaggaca

SEQ ID NO: 10880 - RNA, 18 nt, Artificial Sequence
  Synthetic
agacaauagagagggaca

SEQ ID NO: 10881 - RNA, 19 nt, Artificial Sequence
  Synthetic
gagacaauagagagggaca

SEQ ID NO: 10882 - RNA, 20 nt, Artificial Sequence
  Synthetic
ggagacaauagagagggaca

SEQ ID NO: 10883 - RNA, 21 nt, Artificial Sequence
  Synthetic
gggagacaauagagagggaca

SEQ ID NO: 10884 - RNA, 22 nt, Artificial Sequence
  Synthetic
agggagacaauagagagggaca

SEQ ID NO: 10885 - RNA, 23 nt, Artificial Sequence
  Synthetic
gagggagacaauagagagggaca

SEQ ID NO: 10886 - RNA, 24 nt, Artificial Sequence
  Synthetic
agagggagacaauagagagggaca

SEQ ID NO: 10887 - RNA, 18 nt, Artificial Sequence
  Synthetic
uugagccagguccuuaca

SEQ ID NO: 10888 - RNA, 19 nt, Artificial Sequence
  Synthetic
cuugagccagguccuuaca

SEQ ID NO: 10889 - RNA, 20 nt, Artificial Sequence
  Synthetic
ccuugagccagguccuuaca

SEQ ID NO: 10890 - RNA, 21 nt, Artificial Sequence
  Synthetic
cccuugagccagguccuuaca

SEQ ID NO: 10891 - RNA, 22 nt, Artificial Sequence
  Synthetic
ucccuugagccagguccuuaca

SEQ ID NO: 10892 - RNA, 23 nt, Artificial Sequence
  Synthetic
cucccuugagccagguccuuaca

SEQ ID NO: 10893 - RNA, 24 nt, Artificial Sequence
  Synthetic
ucucccuugagccagguccuuaca

SEQ ID NO: 10894 - RNA, 18 nt, Artificial Sequence
  Synthetic
uagaaggagccagcacca

SEQ ID NO: 10895 - RNA, 19 nt, Artificial Sequence
  Synthetic
auagaaggagccagcacca

SEQ ID NO: 10896 - RNA, 20 nt, Artificial Sequence
  Synthetic
aauagaaggagccagcacca

SEQ ID NO: 10897 - RNA, 21 nt, Artificial Sequence
  Synthetic
aaauagaaggagccagcacca

SEQ ID NO: 10898 - RNA, 22 nt, Artificial Sequence
  Synthetic
caaauagaaggagccagcacca

SEQ ID NO: 10899 - RNA, 23 nt, Artificial Sequence
  Synthetic
gcaaauagaaggagccagcacca

SEQ ID NO: 10900 - RNA, 24 nt, Artificial Sequence
  Synthetic
ggcaaauagaaggagccagcacca

SEQ ID NO: 10901 - RNA, 18 nt, Artificial Sequence
  Synthetic
gcuuccucacgggcccca

SEQ ID NO: 10902 - RNA, 19 nt, Artificial Sequence
  Synthetic
cgcuuccucacgggcccca

SEQ ID NO: 10903 - RNA, 20 nt, Artificial Sequence
  Synthetic
ccgcuuccucacgggcccca

SEQ ID NO: 10904 - RNA, 21 nt, Artificial Sequence
  Synthetic
gccgcuuccucacgggcccca

SEQ ID NO: 10905 - RNA, 22 nt, Artificial Sequence
  Synthetic
ugccgcuuccucacgggcccca

SEQ ID NO: 10906 - RNA, 23 nt, Artificial Sequence
  Synthetic
cugccgcuuccucacgggcccca

SEQ ID NO: 10907 - RNA, 24 nt, Artificial Sequence
  Synthetic
gcugccgcuuccucacgggcccca

SEQ ID NO: 10908 - RNA, 18 nt, Artificial Sequence
  Synthetic
acucaggaagccuuccca

SEQ ID NO: 10909 - RNA, 19 nt, Artificial Sequence
  Synthetic
gacucaggaagccuuccca

SEQ ID NO: 10910 - RNA, 20 nt, Artificial Sequence
  Synthetic
agacucaggaagccuuccca

SEQ ID NO: 10911 - RNA, 21 nt, Artificial Sequence
  Synthetic
gagacucaggaagccuuccca

SEQ ID NO: 10912 - RNA, 22 nt, Artificial Sequence
  Synthetic
ggagacucaggaagccuuccca

SEQ ID NO: 10913 - RNA, 23 nt, Artificial Sequence
  Synthetic
aggagacucaggaagccuuccca

SEQ ID NO: 10914 - RNA, 24 nt, Artificial Sequence
  Synthetic
caggagacucaggaagccuuccca

SEQ ID NO: 10915 - RNA, 18 nt, Artificial Sequence
  Synthetic
ucuccaggaaggagagca

SEQ ID NO: 10916 - RNA, 19 nt, Artificial Sequence
  Synthetic
gucuccaggaaggagagca

SEQ ID NO: 10917 - RNA, 21 nt, Artificial Sequence
  Synthetic
cugucuccaggaaggagagca

SEQ ID NO: 10918 - RNA, 22 nt, Artificial Sequence
  Synthetic
ucugucuccaggaaggagagca

SEQ ID NO: 10919 - RNA, 23 nt, Artificial Sequence
  Synthetic
gucugucuccaggaaggagagca

SEQ ID NO: 10920 - RNA, 24 nt, Artificial Sequence
  Synthetic
agucugucuccaggaaggagagca

SEQ ID NO: 10921 - RNA, 18 nt, Artificial Sequence
  Synthetic
agugccaaguggugagca

SEQ ID NO: 10922 - RNA, 19 nt, Artificial Sequence
  Synthetic
gagugccaaguggugagca

SEQ ID NO: 10923 - RNA, 21 nt, Artificial Sequence
  Synthetic
uggagugccaaguggugagca

SEQ ID NO: 10924 - RNA, 22 nt, Artificial Sequence
  Synthetic
guggagugccaaguggugagca

SEQ ID NO: 10925 - RNA, 23 nt, Artificial Sequence
  Synthetic
aguggagugccaaguggugagca

SEQ ID NO: 10926 - RNA, 24 nt, Artificial Sequence
  Synthetic
gaguggagugccaaguggugagca

SEQ ID NO: 10927 - RNA, 18 nt, Artificial Sequence
  Synthetic
uuuagacgcagacaggca

SEQ ID NO: 10928 - RNA, 19 nt, Artificial Sequence
  Synthetic
cuuuagacgcagacaggca

SEQ ID NO: 10929 - RNA, 21 nt, Artificial Sequence
  Synthetic
ggcuuuagacgcagacaggca

SEQ ID NO: 10930 - RNA, 22 nt, Artificial Sequence
  Synthetic
gggcuuuagacgcagacaggca

SEQ ID NO: 10931 - RNA, 23 nt, Artificial Sequence
  Synthetic
ggggcuuuagacgcagacaggca

SEQ ID NO: 10932 - RNA, 24 nt, Artificial Sequence
  Synthetic
aggggcuuuagacgcagacaggca

SEQ ID NO: 10933 - RNA, 18 nt, Artificial Sequence
  Synthetic
aggcagggaaagcaggca

SEQ ID NO: 10934 - RNA, 19 nt, Artificial Sequence
  Synthetic
gaggcagggaaagcaggca

SEQ ID NO: 10935 - RNA, 20 nt, Artificial Sequence
  Synthetic
agaggcagggaaagcaggca

SEQ ID NO: 10936 - RNA, 21 nt, Artificial Sequence
  Synthetic
aagaggcagggaaagcaggca

SEQ ID NO: 10937 - RNA, 22 nt, Artificial Sequence
  Synthetic
gaagaggcagggaaagcaggca

SEQ ID NO: 10938 - RNA, 23 nt, Artificial Sequence
  Synthetic
ggaagaggcagggaaagcaggca

SEQ ID NO: 10939 - RNA, 24 nt, Artificial Sequence
  Synthetic
aggaagaggcagggaaagcaggca

SEQ ID NO: 10940 - RNA, 18 nt, Artificial Sequence
  Synthetic
caaggaguuuagcaggca

SEQ ID NO: 10941 - RNA, 19 nt, Artificial Sequence
  Synthetic
gcaaggaguuuagcaggca

SEQ ID NO: 10942 - RNA, 20 nt, Artificial Sequence
  Synthetic
agcaaggaguuuagcaggca

SEQ ID NO: 10943 - RNA, 21 nt, Artificial Sequence
  Synthetic
aagcaaggaguuuagcaggca

SEQ ID NO: 10944 - RNA, 22 nt, Artificial Sequence
  Synthetic
caagcaaggaguuuagcaggca

SEQ ID NO: 10945 - RNA, 23 nt, Artificial Sequence
  Synthetic
acaagcaaggaguuuagcaggca

SEQ ID NO: 10946 - RNA, 24 nt, Artificial Sequence
  Synthetic
gacaagcaaggaguuuagcaggca

SEQ ID NO: 10947 - RNA, 18 nt, Artificial Sequence
  Synthetic
ggagcccaggaagaggca

SEQ ID NO: 10948 - RNA, 19 nt, Artificial Sequence
  Synthetic
cggagcccaggaagaggca

SEQ ID NO: 10949 - RNA, 21 nt, Artificial Sequence
  Synthetic
cccggagcccaggaagaggca

SEQ ID NO: 10950 - RNA, 22 nt, Artificial Sequence
  Synthetic
acccggagcccaggaagaggca

SEQ ID NO: 10951 - RNA, 23 nt, Artificial Sequence
  Synthetic
gacccggagcccaggaagaggca

SEQ ID NO: 10952 - RNA, 24 nt, Artificial Sequence
  Synthetic
agacccggagcccaggaagaggca

SEQ ID NO: 10953 - RNA, 18 nt, Artificial Sequence
  Synthetic
caggcccugcacgcggca

SEQ ID NO: 10954 - RNA, 19 nt, Artificial Sequence
  Synthetic
ccaggcccugcacgcggca

SEQ ID NO: 10955 - RNA, 21 nt, Artificial Sequence
  Synthetic
acccaggcccugcacgcggca

SEQ ID NO: 10956 - RNA, 22 nt, Artificial Sequence
  Synthetic
aacccaggcccugcacgcggca

SEQ ID NO: 10957 - RNA, 23 nt, Artificial Sequence
  Synthetic
caacccaggcccugcacgcggca

SEQ ID NO: 10958 - RNA, 24 nt, Artificial Sequence
  Synthetic
acaacccaggcccugcacgcggca

SEQ ID NO: 10959 - RNA, 18 nt, Artificial Sequence
  Synthetic
ucacccucaggcccugca

SEQ ID NO: 10960 - RNA, 19 nt, Artificial Sequence
  Synthetic
cucacccucaggcccugca

SEQ ID NO: 10961 - RNA, 20 nt, Artificial Sequence
  Synthetic
ccucacccucaggcccugca

SEQ ID NO: 10962 - RNA, 21 nt, Artificial Sequence
  Synthetic
gccucacccucaggcccugca

SEQ ID NO: 10963 - RNA, 22 nt, Artificial Sequence
  Synthetic
agccucacccucaggcccugca

SEQ ID NO: 10964 - RNA, 23 nt, Artificial Sequence
  Synthetic
cagccucacccucaggcccugca

SEQ ID NO: 10965 - RNA, 24 nt, Artificial Sequence
  Synthetic
ucagccucacccucaggcccugca

SEQ ID NO: 10966 - RNA, 18 nt, Artificial Sequence
  Synthetic
gcaggcacugaaggugca

SEQ ID NO: 10967 - RNA, 19 nt, Artificial Sequence
  Synthetic
agcaggcacugaaggugca

SEQ ID NO: 10968 - RNA, 21 nt, Artificial Sequence
  Synthetic
aaagcaggcacugaaggugca

SEQ ID NO: 10969 - RNA, 22 nt, Artificial Sequence
  Synthetic
gaaagcaggcacugaaggugca

SEQ ID NO: 10970 - RNA, 23 nt, Artificial Sequence
  Synthetic
ggaaagcaggcacugaaggugca

SEQ ID NO: 10971 - RNA, 24 nt, Artificial Sequence
  Synthetic
gggaaagcaggcacugaaggugca

SEQ ID NO: 10972 - RNA, 18 nt, Artificial Sequence
  Synthetic
cuuccugagacagacuca

SEQ ID NO: 10973 - RNA, 19 nt, Artificial Sequence
  Synthetic
acuuccugagacagacuca

SEQ ID NO: 10974 - RNA, 21 nt, Artificial Sequence
  Synthetic
uuacuuccugagacagacuca

SEQ ID NO: 10975 - RNA, 22 nt, Artificial Sequence
  Synthetic
uuuacuuccugagacagacuca

SEQ ID NO: 10976 - RNA, 23 nt, Artificial Sequence
  Synthetic
auuuacuuccugagacagacuca

SEQ ID NO: 10977 - RNA, 24 nt, Artificial Sequence
  Synthetic
cauuuacuuccugagacagacuca

SEQ ID NO: 10978 - RNA, 18 nt, Artificial Sequence
  Synthetic
gacaggagggcagaaaga

SEQ ID NO: 10979 - RNA, 19 nt, Artificial Sequence
  Synthetic
ggacaggagggcagaaaga

SEQ ID NO: 10980 - RNA, 21 nt, Artificial Sequence
  Synthetic
gaggacaggagggcagaaaga

SEQ ID NO: 10981 - RNA, 22 nt, Artificial Sequence
  Synthetic
ggaggacaggagggcagaaaga

SEQ ID NO: 10982 - RNA, 23 nt, Artificial Sequence
  Synthetic
gggaggacaggagggcagaaaga

SEQ ID NO: 10983 - RNA, 24 nt, Artificial Sequence
  Synthetic
cgggaggacaggagggcagaaaga

SEQ ID NO: 10984 - RNA, 18 nt, Artificial Sequence
  Synthetic
caggcccugcagagaaga

SEQ ID NO: 10985 - RNA, 19 nt, Artificial Sequence
  Synthetic
ucaggcccugcagagaaga

SEQ ID NO: 10986 - RNA, 20 nt, Artificial Sequence
  Synthetic
cucaggcccugcagagaaga

SEQ ID NO: 10987 - RNA, 21 nt, Artificial Sequence
  Synthetic
ccucaggcccugcagagaaga

SEQ ID NO: 10988 - RNA, 22 nt, Artificial Sequence
  Synthetic
cccucaggcccugcagagaaga

SEQ ID NO: 10989 - RNA, 23 nt, Artificial Sequence
  Synthetic
acccucaggcccugcagagaaga

SEQ ID NO: 10990 - RNA, 24 nt, Artificial Sequence
  Synthetic
cacccucaggcccugcagagaaga

SEQ ID NO: 10991 - RNA, 18 nt, Artificial Sequence
  Synthetic
ggaggacaggagggcaga

SEQ ID NO: 10992 - RNA, 19 nt, Artificial Sequence
  Synthetic
gggaggacaggagggcaga

SEQ ID NO: 10993 - RNA, 20 nt, Artificial Sequence
  Synthetic
cgggaggacaggagggcaga

SEQ ID NO: 10994 - RNA, 21 nt, Artificial Sequence
  Synthetic
ccgggaggacaggagggcaga

SEQ ID NO: 10995 - RNA, 22 nt, Artificial Sequence
  Synthetic
accgggaggacaggagggcaga

SEQ ID NO: 10996 - RNA, 23 nt, Artificial Sequence
  Synthetic
aaccgggaggacaggagggcaga

SEQ ID NO: 10997 - RNA, 24 nt, Artificial Sequence
  Synthetic
gaaccgggaggacaggagggcaga

SEQ ID NO: 10998 - RNA, 18 nt, Artificial Sequence
  Synthetic
cagcgaaggacagagaga

SEQ ID NO: 10999 - RNA, 19 nt, Artificial Sequence
  Synthetic
acagcgaaggacagagaga

SEQ ID NO: 11000 - RNA, 20 nt, Artificial Sequence
  Synthetic
gacagcgaaggacagagaga

SEQ ID NO: 11001 - RNA, 21 nt, Artificial Sequence
  Synthetic
ggacagcgaaggacagagaga

SEQ ID NO: 11002 - RNA, 22 nt, Artificial Sequence
  Synthetic
gggacagcgaaggacagagaga

SEQ ID NO: 11003 - RNA, 23 nt, Artificial Sequence
  Synthetic
agggacagcgaaggacagagaga

SEQ ID NO: 11004 - RNA, 24 nt, Artificial Sequence
  Synthetic
gagggacagcgaaggacagagaga

SEQ ID NO: 11005 - RNA, 18 nt, Artificial Sequence
  Synthetic
guggugagcaaggagaga

SEQ ID NO: 11006 - RNA, 19 nt, Artificial Sequence
  Synthetic
aguggugagcaaggagaga

SEQ ID NO: 11007 - RNA, 20 nt, Artificial Sequence
  Synthetic
aaguggugagcaaggagaga

SEQ ID NO: 11008 - RNA, 21 nt, Artificial Sequence
  Synthetic
caaguggugagcaaggagaga

SEQ ID NO: 11009 - RNA, 22 nt, Artificial Sequence
  Synthetic
ccaaguggugagcaaggagaga

SEQ ID NO: 11010 - RNA, 23 nt, Artificial Sequence
  Synthetic
gccaaguggugagcaaggagaga

SEQ ID NO: 11011 - RNA, 24 nt, Artificial Sequence
  Synthetic
ugccaaguggugagcaaggagaga

SEQ ID NO: 11012 - RNA, 18 nt, Artificial Sequence
  Synthetic
gagggcaacacaaggaga

SEQ ID NO: 11013 - RNA, 19 nt, Artificial Sequence
  Synthetic
ggagggcaacacaaggaga

SEQ ID NO: 11014 - RNA, 21 nt, Artificial Sequence
  Synthetic
uaggagggcaacacaaggaga

SEQ ID NO: 11015 - RNA, 22 nt, Artificial Sequence
  Synthetic
cuaggagggcaacacaaggaga

SEQ ID NO: 11016 - RNA, 23 nt, Artificial Sequence
  Synthetic
gcuaggagggcaacacaaggaga

SEQ ID NO: 11017 - RNA, 24 nt, Artificial Sequence
  Synthetic
agcuaggagggcaacacaaggaga

SEQ ID NO: 11018 - RNA, 18 nt, Artificial Sequence
  Synthetic
aaguggugagcaaggaga

SEQ ID NO: 11019 - RNA, 19 nt, Artificial Sequence
  Synthetic
caaguggugagcaaggaga

SEQ ID NO: 11020 - RNA, 20 nt, Artificial Sequence
  Synthetic
ccaaguggugagcaaggaga

SEQ ID NO: 11021 - RNA, 21 nt, Artificial Sequence
  Synthetic
gccaaguggugagcaaggaga

SEQ ID NO: 11022 - RNA, 22 nt, Artificial Sequence
  Synthetic
ugccaaguggugagcaaggaga

SEQ ID NO: 11023 - RNA, 23 nt, Artificial Sequence
  Synthetic
gugccaaguggugagcaaggaga

SEQ ID NO: 11024 - RNA, 24 nt, Artificial Sequence
  Synthetic
agugccaaguggugagcaaggaga

SEQ ID NO: 11025 - RNA, 18 nt, Artificial Sequence
  Synthetic
guggugggggcaaauaga

SEQ ID NO: 11026 - RNA, 19 nt, Artificial Sequence
  Synthetic
aguggugggggcaaauaga

SEQ ID NO: 11027 - RNA, 21 nt, Artificial Sequence
  Synthetic
gcaguggugggggcaaauaga

SEQ ID NO: 11028 - RNA, 22 nt, Artificial Sequence
  Synthetic
ggcaguggugggggcaaauaga

SEQ ID NO: 11029 - RNA, 23 nt, Artificial Sequence
  Synthetic
gggcaguggugggggcaaauaga

SEQ ID NO: 11030 - RNA, 24 nt, Artificial Sequence
  Synthetic
ggggcaguggugggggcaaauaga

SEQ ID NO: 11031 - RNA, 18 nt, Artificial Sequence
  Synthetic
aaagagggagacaauaga

SEQ ID NO: 11032 - RNA, 19 nt, Artificial Sequence
  Synthetic
gaaagagggagacaauaga

SEQ ID NO: 11033 - RNA, 20 nt, Artificial Sequence
  Synthetic
agaaagagggagacaauaga

SEQ ID NO: 11034 - RNA, 21 nt, Artificial Sequence
  Synthetic
cagaaagagggagacaauaga

SEQ ID NO: 11035 - RNA, 22 nt, Artificial Sequence
  Synthetic
gcagaaagagggagacaauaga

SEQ ID NO: 11036 - RNA, 23 nt, Artificial Sequence
  Synthetic
ggcagaaagagggagacaauaga

SEQ ID NO: 11037 - RNA, 24 nt, Artificial Sequence
  Synthetic
gggcagaaagagggagacaauaga

SEQ ID NO: 11038 - RNA, 18 nt, Artificial Sequence
  Synthetic
gagccgggaguuuuccga

SEQ ID NO: 11039 - RNA, 19 nt, Artificial Sequence
  Synthetic
agagccgggaguuuuccga

SEQ ID NO: 11040 - RNA, 21 nt, Artificial Sequence
  Synthetic
ucagagccgggaguuuuccga

SEQ ID NO: 11041 - RNA, 22 nt, Artificial Sequence
  Synthetic
gucagagccgggaguuuuccga

SEQ ID NO: 11042 - RNA, 23 nt, Artificial Sequence
  Synthetic
agucagagccgggaguuuuccga

SEQ ID NO: 11043 - RNA, 24 nt, Artificial Sequence
  Synthetic
gagucagagccgggaguuuuccga

SEQ ID NO: 11044 - RNA, 18 nt, Artificial Sequence
  Synthetic
ggccagggauggaagcga

SEQ ID NO: 11045 - RNA, 19 nt, Artificial Sequence
  Synthetic
cggccagggauggaagcga

SEQ ID NO: 11046 - RNA, 20 nt, Artificial Sequence
  Synthetic
ccggccagggauggaagcga

SEQ ID NO: 11047 - RNA, 21 nt, Artificial Sequence
  Synthetic
gccggccagggauggaagcga

SEQ ID NO: 11048 - RNA, 22 nt, Artificial Sequence
  Synthetic
ggccggccagggauggaagcga

SEQ ID NO: 11049 - RNA, 23 nt, Artificial Sequence
  Synthetic
uggccggccagggauggaagcga

SEQ ID NO: 11050 - RNA, 24 nt, Artificial Sequence
  Synthetic
cuggccggccagggauggaagcga

SEQ ID NO: 11051 - RNA, 18 nt, Artificial Sequence
  Synthetic
ccaaguggugagcaagga

SEQ ID NO: 11052 - RNA, 19 nt, Artificial Sequence
  Synthetic
gccaaguggugagcaagga

SEQ ID NO: 11053 - RNA, 20 nt, Artificial Sequence
  Synthetic
ugccaaguggugagcaagga

SEQ ID NO: 11054 - RNA, 21 nt, Artificial Sequence
  Synthetic
gugccaaguggugagcaagga

SEQ ID NO: 11055 - RNA, 22 nt, Artificial Sequence
  Synthetic
agugccaaguggugagcaagga

SEQ ID NO: 11056 - RNA, 23 nt, Artificial Sequence
  Synthetic
gagugccaaguggugagcaagga

SEQ ID NO: 11057 - RNA, 24 nt, Artificial Sequence
  Synthetic
ggagugccaaguggugagcaagga

SEQ ID NO: 11058 - RNA, 18 nt, Artificial Sequence
  Synthetic
cgggaguuuuccgaagga

SEQ ID NO: 11059 - RNA, 19 nt, Artificial Sequence
  Synthetic
ccgggaguuuuccgaagga

SEQ ID NO: 11060 - RNA, 21 nt, Artificial Sequence
  Synthetic
agccgggaguuuuccgaagga

SEQ ID NO: 11061 - RNA, 22 nt, Artificial Sequence
  Synthetic
gagccgggaguuuuccgaagga

SEQ ID NO: 11062 - RNA, 23 nt, Artificial Sequence
  Synthetic
agagccgggaguuuuccgaagga

SEQ ID NO: 11063 - RNA, 24 nt, Artificial Sequence
  Synthetic
cagagccgggaguuuuccgaagga

SEQ ID NO: 11064 - RNA, 18 nt, Artificial Sequence
  Synthetic
gagagggacagcgaagga

SEQ ID NO: 11065 - RNA, 19 nt, Artificial Sequence
  Synthetic
agagagggacagcgaagga

SEQ ID NO: 11066 - RNA, 20 nt, Artificial Sequence
  Synthetic
uagagagggacagcgaagga

SEQ ID NO: 11067 - RNA, 21 nt, Artificial Sequence
  Synthetic
auagagagggacagcgaagga

SEQ ID NO: 11068 - RNA, 22 nt, Artificial Sequence
  Synthetic
aauagagagggacagcgaagga

SEQ ID NO: 11069 - RNA, 23 nt, Artificial Sequence
  Synthetic
caauagagagggacagcgaagga

SEQ ID NO: 11070 - RNA, 24 nt, Artificial Sequence
  Synthetic
acaauagagagggacagcgaagga

SEQ ID NO: 11071 - RNA, 18 nt, Artificial Sequence
  Synthetic
gcagcaaaaggauaagga

SEQ ID NO: 11072 - RNA, 19 nt, Artificial Sequence
  Synthetic
ugcagcaaaaggauaagga

SEQ ID NO: 11073 - RNA, 20 nt, Artificial Sequence
  Synthetic
augcagcaaaaggauaagga

SEQ ID NO: 11074 - RNA, 21 nt, Artificial Sequence
  Synthetic
aaugcagcaaaaggauaagga

SEQ ID NO: 11075 - RNA, 22 nt, Artificial Sequence
  Synthetic
uaaugcagcaaaaggauaagga

SEQ ID NO: 11076 - RNA, 23 nt, Artificial Sequence
  Synthetic
uuaaugcagcaaaaggauaagga

SEQ ID NO: 11077 - RNA, 24 nt, Artificial Sequence
  Synthetic
cuuaaugcagcaaaaggauaagga

SEQ ID NO: 11078 - RNA, 18 nt, Artificial Sequence
  Synthetic
gggagucugucuccagga

SEQ ID NO: 11079 - RNA, 19 nt, Artificial Sequence
  Synthetic
agggagucugucuccagga

SEQ ID NO: 11080 - RNA, 21 nt, Artificial Sequence
  Synthetic
aaagggagucugucuccagga

SEQ ID NO: 11081 - RNA, 22 nt, Artificial Sequence
  Synthetic
caaagggagucugucuccagga

SEQ ID NO: 11082 - RNA, 23 nt, Artificial Sequence
  Synthetic
ccaaagggagucugucuccagga

SEQ ID NO: 11083 - RNA, 24 nt, Artificial Sequence
  Synthetic
accaaagggagucugucuccagga

SEQ ID NO: 11084 - RNA, 18 nt, Artificial Sequence
  Synthetic
gguggggaaccgggagga

SEQ ID NO: 11085 - RNA, 19 nt, Artificial Sequence
  Synthetic
ggguggggaaccgggagga

SEQ ID NO: 11086 - RNA, 20 nt, Artificial Sequence
  Synthetic
uggguggggaaccgggagga

SEQ ID NO: 11087 - RNA, 21 nt, Artificial Sequence
  Synthetic
cuggguggggaaccgggagga

SEQ ID NO: 11088 - RNA, 22 nt, Artificial Sequence
  Synthetic
ccuggguggggaaccgggagga

SEQ ID NO: 11089 - RNA, 23 nt, Artificial Sequence
  Synthetic
gccuggguggggaaccgggagga

SEQ ID NO: 11090 - RNA, 24 nt, Artificial Sequence
  Synthetic
ggccuggguggggaaccgggagga

SEQ ID NO: 11091 - RNA, 18 nt, Artificial Sequence
  Synthetic
ccgcuggccggccaggga

SEQ ID NO: 11092 - RNA, 19 nt, Artificial Sequence
  Synthetic
cccgcuggccggccaggga

SEQ ID NO: 11093 - RNA, 21 nt, Artificial Sequence
  Synthetic
cgcccgcuggccggccaggga

SEQ ID NO: 11094 - RNA, 22 nt, Artificial Sequence
  Synthetic
ccgcccgcuggccggccaggga

SEQ ID NO: 11095 - RNA, 23 nt, Artificial Sequence
  Synthetic
cccgcccgcuggccggccaggga

SEQ ID NO: 11096 - RNA, 24 nt, Artificial Sequence
  Synthetic
gcccgcccgcuggccggccaggga

SEQ ID NO: 11097 - RNA, 18 nt, Artificial Sequence
  Synthetic
aggacagagagauaggga

SEQ ID NO: 11098 - RNA, 19 nt, Artificial Sequence
  Synthetic
aaggacagagagauaggga

SEQ ID NO: 11099 - RNA, 21 nt, Artificial Sequence
  Synthetic
cgaaggacagagagauaggga

SEQ ID NO: 11100 - RNA, 22 nt, Artificial Sequence
  Synthetic
gcgaaggacagagagauaggga

SEQ ID NO: 11101 - RNA, 23 nt, Artificial Sequence
  Synthetic
agcgaaggacagagagauaggga

SEQ ID NO: 11102 - RNA, 24 nt, Artificial Sequence
  Synthetic
cagcgaaggacagagagauaggga

SEQ ID NO: 11103 - RNA, 18 nt, Artificial Sequence
  Synthetic
agacagacucauggggga

SEQ ID NO: 11104 - RNA, 19 nt, Artificial Sequence
  Synthetic
gagacagacucauggggga

SEQ ID NO: 11105 - RNA, 20 nt, Artificial Sequence
  Synthetic
ugagacagacucauggggga

SEQ ID NO: 11106 - RNA, 21 nt, Artificial Sequence
  Synthetic
cugagacagacucauggggga

SEQ ID NO: 11107 - RNA, 22 nt, Artificial Sequence
  Synthetic
ccugagacagacucauggggga

SEQ ID NO: 11108 - RNA, 23 nt, Artificial Sequence
  Synthetic
uccugagacagacucauggggga

SEQ ID NO: 11109 - RNA, 24 nt, Artificial Sequence
  Synthetic
uuccugagacagacucauggggga

SEQ ID NO: 11110 - RNA, 18 nt, Artificial Sequence
  Synthetic
gauguggccagcgcugga

SEQ ID NO: 11111 - RNA, 19 nt, Artificial Sequence
  Synthetic
ggauguggccagcgcugga

SEQ ID NO: 11112 - RNA, 20 nt, Artificial Sequence
  Synthetic
aggauguggccagcgcugga

SEQ ID NO: 11113 - RNA, 21 nt, Artificial Sequence
  Synthetic
gaggauguggccagcgcugga

SEQ ID NO: 11114 - RNA, 22 nt, Artificial Sequence
  Synthetic
ggaggauguggccagcgcugga

SEQ ID NO: 11115 - RNA, 23 nt, Artificial Sequence
  Synthetic
gggaggauguggccagcgcugga

SEQ ID NO: 11116 - RNA, 24 nt, Artificial Sequence
  Synthetic
agggaggauguggccagcgcugga

SEQ ID NO: 11117 - RNA, 18 nt, Artificial Sequence
  Synthetic
ucccagguugcggcugga

SEQ ID NO: 11118 - RNA, 19 nt, Artificial Sequence
  Synthetic
cucccagguugcggcugga

SEQ ID NO: 11119 - RNA, 20 nt, Artificial Sequence
  Synthetic
acucccagguugcggcugga

SEQ ID NO: 11120 - RNA, 21 nt, Artificial Sequence
  Synthetic
cacucccagguugcggcugga

SEQ ID NO: 11121 - RNA, 22 nt, Artificial Sequence
  Synthetic
ccacucccagguugcggcugga

SEQ ID NO: 11122 - RNA, 23 nt, Artificial Sequence
  Synthetic
cccacucccagguugcggcugga

SEQ ID NO: 11123 - RNA, 24 nt, Artificial Sequence
  Synthetic
ucccacucccagguugcggcugga

SEQ ID NO: 11124 - RNA, 18 nt, Artificial Sequence
  Synthetic
ucuccucugcuucccuga

SEQ ID NO: 11125 - RNA, 19 nt, Artificial Sequence
  Synthetic
cucuccucugcuucccuga

SEQ ID NO: 11126 - RNA, 20 nt, Artificial Sequence
  Synthetic
ccucuccucugcuucccuga

SEQ ID NO: 11127 - RNA, 21 nt, Artificial Sequence
  Synthetic
gccucuccucugcuucccuga

SEQ ID NO: 11128 - RNA, 22 nt, Artificial Sequence
  Synthetic
ggccucuccucugcuucccuga

SEQ ID NO: 11129 - RNA, 23 nt, Artificial Sequence
  Synthetic
cggccucuccucugcuucccuga

SEQ ID NO: 11130 - RNA, 24 nt, Artificial Sequence
  Synthetic
acggccucuccucugcuucccuga

SEQ ID NO: 11131 - RNA, 18 nt, Artificial Sequence
  Synthetic
aggggccagccaggcuga

SEQ ID NO: 11132 - RNA, 19 nt, Artificial Sequence
  Synthetic
aaggggccagccaggcuga

SEQ ID NO: 11133 - RNA, 20 nt, Artificial Sequence
  Synthetic
gaaggggccagccaggcuga

SEQ ID NO: 11134 - RNA, 21 nt, Artificial Sequence
  Synthetic
agaaggggccagccaggcuga

SEQ ID NO: 11135 - RNA, 22 nt, Artificial Sequence
  Synthetic
gagaaggggccagccaggcuga

SEQ ID NO: 11136 - RNA, 23 nt, Artificial Sequence
  Synthetic
ggagaaggggccagccaggcuga

SEQ ID NO: 11137 - RNA, 24 nt, Artificial Sequence
  Synthetic
aggagaaggggccagccaggcuga

SEQ ID NO: 11138 - RNA, 18 nt, Artificial Sequence
  Synthetic
agaaagagggagacaaua

SEQ ID NO: 11139 - RNA, 19 nt, Artificial Sequence
  Synthetic
cagaaagagggagacaaua

SEQ ID NO: 11140 - RNA, 20 nt, Artificial Sequence
  Synthetic
gcagaaagagggagacaaua

SEQ ID NO: 11141 - RNA, 21 nt, Artificial Sequence
  Synthetic
ggcagaaagagggagacaaua

SEQ ID NO: 11142 - RNA, 22 nt, Artificial Sequence
  Synthetic
gggcagaaagagggagacaaua

SEQ ID NO: 11143 - RNA, 23 nt, Artificial Sequence
  Synthetic
agggcagaaagagggagacaaua

SEQ ID NO: 11144 - RNA, 24 nt, Artificial Sequence
  Synthetic
gagggcagaaagagggagacaaua

SEQ ID NO: 11145 - RNA, 18 nt, Artificial Sequence
  Synthetic
uuuuucuucauuguccua

SEQ ID NO: 11146 - RNA, 19 nt, Artificial Sequence
  Synthetic
auuuuucuucauuguccua

SEQ ID NO: 11147 - RNA, 20 nt, Artificial Sequence
  Synthetic
gauuuuucuucauuguccua

SEQ ID NO: 11148 - RNA, 21 nt, Artificial Sequence
  Synthetic
ggauuuuucuucauuguccua

SEQ ID NO: 11149 - RNA, 22 nt, Artificial Sequence
  Synthetic
uggauuuuucuucauuguccua

SEQ ID NO: 11150 - RNA, 23 nt, Artificial Sequence
  Synthetic
cuggauuuuucuucauuguccua

SEQ ID NO: 11151 - RNA, 24 nt, Artificial Sequence
  Synthetic
gcuggauuuuucuucauuguccua

SEQ ID NO: 11152 - RNA, 18 nt, Artificial Sequence
  Synthetic
cauaagagccaagggcua

SEQ ID NO: 11153 - RNA, 19 nt, Artificial Sequence
  Synthetic
acauaagagccaagggcua

SEQ ID NO: 11154 - RNA, 21 nt, Artificial Sequence
  Synthetic
agacauaagagccaagggcua

SEQ ID NO: 11155 - RNA, 22 nt, Artificial Sequence
  Synthetic
aagacauaagagccaagggcua

SEQ ID NO: 11156 - RNA, 23 nt, Artificial Sequence
  Synthetic
uaagacauaagagccaagggcua

SEQ ID NO: 11157 - RNA, 24 nt, Artificial Sequence
  Synthetic
auaagacauaagagccaagggcua

SEQ ID NO: 11158 - RNA, 18 nt, Artificial Sequence
  Synthetic
gcaggugaacugggagua

SEQ ID NO: 11159 - RNA, 19 nt, Artificial Sequence
  Synthetic
ggcaggugaacugggagua

SEQ ID NO: 11160 - RNA, 20 nt, Artificial Sequence
  Synthetic
gggcaggugaacugggagua

SEQ ID NO: 11161 - RNA, 21 nt, Artificial Sequence
  Synthetic
agggcaggugaacugggagua

SEQ ID NO: 11162 - RNA, 22 nt, Artificial Sequence
  Synthetic
gagggcaggugaacugggagua

SEQ ID NO: 11163 - RNA, 23 nt, Artificial Sequence
  Synthetic
cgagggcaggugaacugggagua

SEQ ID NO: 11164 - RNA, 24 nt, Artificial Sequence
  Synthetic
ccgagggcaggugaacugggagua

SEQ ID NO: 11165 - RNA, 18 nt, Artificial Sequence
  Synthetic
ugcaggaaugugggcaac

SEQ ID NO: 11166 - RNA, 19 nt, Artificial Sequence
  Synthetic
uugcaggaaugugggcaac

SEQ ID NO: 11167 - RNA, 20 nt, Artificial Sequence
  Synthetic
guugcaggaaugugggcaac

SEQ ID NO: 11168 - RNA, 21 nt, Artificial Sequence
  Synthetic
aguugcaggaaugugggcaac

SEQ ID NO: 11169 - RNA, 22 nt, Artificial Sequence
  Synthetic
gaguugcaggaaugugggcaac

SEQ ID NO: 11170 - RNA, 23 nt, Artificial Sequence
  Synthetic
agaguugcaggaaugugggcaac

SEQ ID NO: 11171 - RNA, 24 nt, Artificial Sequence
  Synthetic
cagaguugcaggaaugugggcaac

SEQ ID NO: 11172 - RNA, 18 nt, Artificial Sequence
  Synthetic
agggccuggguggggaac

SEQ ID NO: 11173 - RNA, 19 nt, Artificial Sequence
  Synthetic
gagggccuggguggggaac

SEQ ID NO: 11174 - RNA, 21 nt, Artificial Sequence
  Synthetic
gagagggccuggguggggaac

SEQ ID NO: 11175 - RNA, 22 nt, Artificial Sequence
  Synthetic
ugagagggccuggguggggaac

SEQ ID NO: 11176 - RNA, 23 nt, Artificial Sequence
  Synthetic
cugagagggccuggguggggaac

SEQ ID NO: 11177 - RNA, 24 nt, Artificial Sequence
  Synthetic
gcugagagggccuggguggggaac

SEQ ID NO: 11178 - RNA, 18 nt, Artificial Sequence
  Synthetic
ucccgagggcaggugaac

SEQ ID NO: 11179 - RNA, 19 nt, Artificial Sequence
  Synthetic
cucccgagggcaggugaac

SEQ ID NO: 11180 - RNA, 21 nt, Artificial Sequence
  Synthetic
ggcucccgagggcaggugaac

SEQ ID NO: 11181 - RNA, 22 nt, Artificial Sequence
  Synthetic
gggcucccgagggcaggugaac

SEQ ID NO: 11182 - RNA, 23 nt, Artificial Sequence
  Synthetic
agggcucccgagggcaggugaac

SEQ ID NO: 11183 - RNA, 24 nt, Artificial Sequence
  Synthetic
gagggcucccgagggcaggugaac

SEQ ID NO: 11184 - RNA, 18 nt, Artificial Sequence
  Synthetic
cagcuaggagggcaacac

SEQ ID NO: 11185 - RNA, 19 nt, Artificial Sequence
  Synthetic
acagcuaggagggcaacac

SEQ ID NO: 11186 - RNA, 20 nt, Artificial Sequence
  Synthetic
cacagcuaggagggcaacac

SEQ ID NO: 11187 - RNA, 21 nt, Artificial Sequence
  Synthetic
ccacagcuaggagggcaacac

SEQ ID NO: 11188 - RNA, 22 nt, Artificial Sequence
  Synthetic
cccacagcuaggagggcaacac

SEQ ID NO: 11189 - RNA, 23 nt, Artificial Sequence
  Synthetic
gcccacagcuaggagggcaacac

SEQ ID NO: 11190 - RNA, 24 nt, Artificial Sequence
  Synthetic
agcccacagcuaggagggcaacac

SEQ ID NO: 11191 - RNA, 18 nt, Artificial Sequence
  Synthetic
cugagcauugauacacac

SEQ ID NO: 11192 - RNA, 19 nt, Artificial Sequence
  Synthetic
ccugagcauugauacacac

SEQ ID NO: 11193 - RNA, 21 nt, Artificial Sequence
  Synthetic
agccugagcauugauacacac

SEQ ID NO: 11194 - RNA, 22 nt, Artificial Sequence
  Synthetic
cagccugagcauugauacacac

SEQ ID NO: 11195 - RNA, 23 nt, Artificial Sequence
  Synthetic
ccagccugagcauugauacacac

SEQ ID NO: 11196 - RNA, 24 nt, Artificial Sequence
  Synthetic
cccagccugagcauugauacacac

SEQ ID NO: 11197 - RNA, 18 nt, Artificial Sequence
  Synthetic
cuuccucacgggccccac

SEQ ID NO: 11198 - RNA, 19 nt, Artificial Sequence
  Synthetic
gcuuccucacgggccccac

SEQ ID NO: 11199 - RNA, 21 nt, Artificial Sequence
  Synthetic
ccgcuuccucacgggccccac

SEQ ID NO: 11200 - RNA, 22 nt, Artificial Sequence
  Synthetic
gccgcuuccucacgggccccac

SEQ ID NO: 11201 - RNA, 23 nt, Artificial Sequence
  Synthetic
ugccgcuuccucacgggccccac

SEQ ID NO: 11202 - RNA, 24 nt, Artificial Sequence
  Synthetic
cugccgcuuccucacgggccccac

SEQ ID NO: 11203 - RNA, 18 nt, Artificial Sequence
  Synthetic
gacacuguggacacagac

SEQ ID NO: 11204 - RNA, 19 nt, Artificial Sequence
  Synthetic
ggacacuguggacacagac

SEQ ID NO: 11205 - RNA, 20 nt, Artificial Sequence
  Synthetic
aggacacuguggacacagac

SEQ ID NO: 11206 - RNA, 21 nt, Artificial Sequence
  Synthetic
caggacacuguggacacagac

SEQ ID NO: 11207 - RNA, 22 nt, Artificial Sequence
  Synthetic
gcaggacacuguggacacagac

SEQ ID NO: 11208 - RNA, 23 nt, Artificial Sequence
  Synthetic
cgcaggacacuguggacacagac

SEQ ID NO: 11209 - RNA, 24 nt, Artificial Sequence
  Synthetic
acgcaggacacuguggacacagac

SEQ ID NO: 11210 - RNA, 18 nt, Artificial Sequence
  Synthetic
cuccaaccuuguccagac

SEQ ID NO: 11211 - RNA, 19 nt, Artificial Sequence
  Synthetic
ccuccaaccuuguccagac

SEQ ID NO: 11212 - RNA, 20 nt, Artificial Sequence
  Synthetic
cccuccaaccuuguccagac

SEQ ID NO: 11213 - RNA, 21 nt, Artificial Sequence
  Synthetic
ccccuccaaccuuguccagac

SEQ ID NO: 11214 - RNA, 22 nt, Artificial Sequence
  Synthetic
cccccuccaaccuuguccagac

SEQ ID NO: 11215 - RNA, 23 nt, Artificial Sequence
  Synthetic
acccccuccaaccuuguccagac

SEQ ID NO: 11216 - RNA, 24 nt, Artificial Sequence
  Synthetic
cacccccuccaaccuuguccagac

SEQ ID NO: 11217 - RNA, 18 nt, Artificial Sequence
  Synthetic
aaaagggcuggaggagac

SEQ ID NO: 11218 - RNA, 19 nt, Artificial Sequence
  Synthetic
aaaaagggcuggaggagac

SEQ ID NO: 11219 - RNA, 20 nt, Artificial Sequence
  Synthetic
caaaaagggcuggaggagac

SEQ ID NO: 11220 - RNA, 21 nt, Artificial Sequence
  Synthetic
ccaaaaagggcuggaggagac

SEQ ID NO: 11221 - RNA, 22 nt, Artificial Sequence
  Synthetic
cccaaaaagggcuggaggagac

SEQ ID NO: 11222 - RNA, 23 nt, Artificial Sequence
  Synthetic
acccaaaaagggcuggaggagac

SEQ ID NO: 11223 - RNA, 24 nt, Artificial Sequence
  Synthetic
gacccaaaaagggcuggaggagac

SEQ ID NO: 11224 - RNA, 18 nt, Artificial Sequence
  Synthetic
guggggaaccgggaggac

SEQ ID NO: 11225 - RNA, 19 nt, Artificial Sequence
  Synthetic
gguggggaaccgggaggac

SEQ ID NO: 11226 - RNA, 21 nt, Artificial Sequence
  Synthetic
uggguggggaaccgggaggac

SEQ ID NO: 11227 - RNA, 22 nt, Artificial Sequence
  Synthetic
cuggguggggaaccgggaggac

SEQ ID NO: 11228 - RNA, 23 nt, Artificial Sequence
  Synthetic
ccuggguggggaaccgggaggac

SEQ ID NO: 11229 - RNA, 24 nt, Artificial Sequence
  Synthetic
gccuggguggggaaccgggaggac

SEQ ID NO: 11230 - RNA, 18 nt, Artificial Sequence
  Synthetic
gaacugggaguacuggac

SEQ ID NO: 11231 - RNA, 19 nt, Artificial Sequence
  Synthetic
ugaacugggaguacuggac

SEQ ID NO: 11232 - RNA, 20 nt, Artificial Sequence
  Synthetic
gugaacugggaguacuggac

SEQ ID NO: 11233 - RNA, 21 nt, Artificial Sequence
  Synthetic
ggugaacugggaguacuggac

SEQ ID NO: 11234 - RNA, 22 nt, Artificial Sequence
  Synthetic
aggugaacugggaguacuggac

SEQ ID NO: 11235 - RNA, 23 nt, Artificial Sequence
  Synthetic
caggugaacugggaguacuggac

SEQ ID NO: 11236 - RNA, 24 nt, Artificial Sequence
  Synthetic
gcaggugaacugggaguacuggac

SEQ ID NO: 11237 - RNA, 18 nt, Artificial Sequence
  Synthetic
cccagguugcggcuggac

SEQ ID NO: 11238 - RNA, 19 nt, Artificial Sequence
  Synthetic
ucccagguugcggcuggac

SEQ ID NO: 11239 - RNA, 21 nt, Artificial Sequence
  Synthetic
acucccagguugcggcuggac

SEQ ID NO: 11240 - RNA, 22 nt, Artificial Sequence
  Synthetic
cacucccagguugcggcuggac

SEQ ID NO: 11241 - RNA, 23 nt, Artificial Sequence
  Synthetic
ccacucccagguugcggcuggac

SEQ ID NO: 11242 - RNA, 24 nt, Artificial Sequence
  Synthetic
cccacucccagguugcggcuggac

SEQ ID NO: 11243 - RNA, 18 nt, Artificial Sequence
  Synthetic
gggccuggguggggaacc

SEQ ID NO: 11244 - RNA, 19 nt, Artificial Sequence
  Synthetic
agggccuggguggggaacc

SEQ ID NO: 11245 - RNA, 21 nt, Artificial Sequence
  Synthetic
agagggccuggguggggaacc

SEQ ID NO: 11246 - RNA, 22 nt, Artificial Sequence
  Synthetic
gagagggccuggguggggaacc

SEQ ID NO: 11247 - RNA, 23 nt, Artificial Sequence
  Synthetic
ugagagggccuggguggggaacc

SEQ ID NO: 11248 - RNA, 24 nt, Artificial Sequence
  Synthetic
cugagagggccuggguggggaacc

SEQ ID NO: 11249 - RNA, 18 nt, Artificial Sequence
  Synthetic
ugagcauugauacacacc

SEQ ID NO: 11250 - RNA, 19 nt, Artificial Sequence
  Synthetic
cugagcauugauacacacc

SEQ ID NO: 11251 - RNA, 21 nt, Artificial Sequence
  Synthetic
gccugagcauugauacacacc

SEQ ID NO: 11252 - RNA, 22 nt, Artificial Sequence
  Synthetic
agccugagcauugauacacacc

SEQ ID NO: 11253 - RNA, 23 nt, Artificial Sequence
  Synthetic
cagccugagcauugauacacacc

SEQ ID NO: 11254 - RNA, 24 nt, Artificial Sequence
  Synthetic
ccagccugagcauugauacacacc

SEQ ID NO: 11255 - RNA, 18 nt, Artificial Sequence
  Synthetic
acacuguggacacagacc

SEQ ID NO: 11256 - RNA, 19 nt, Artificial Sequence
  Synthetic
gacacuguggacacagacc

SEQ ID NO: 11257 - RNA, 21 nt, Artificial Sequence
  Synthetic
aggacacuguggacacagacc

SEQ ID NO: 11258 - RNA, 22 nt, Artificial Sequence
  Synthetic
caggacacuguggacacagacc

SEQ ID NO: 11259 - RNA, 23 nt, Artificial Sequence
  Synthetic
gcaggacacuguggacacagacc

SEQ ID NO: 11260 - RNA, 24 nt, Artificial Sequence
  Synthetic
cgcaggacacuguggacacagacc

SEQ ID NO: 11261 - RNA, 18 nt, Artificial Sequence
  Synthetic
uccaaccuuguccagacc

SEQ ID NO: 11262 - RNA, 19 nt, Artificial Sequence
  Synthetic
cuccaaccuuguccagacc

SEQ ID NO: 11263 - RNA, 21 nt, Artificial Sequence
  Synthetic
cccuccaaccuuguccagacc

SEQ ID NO: 11264 - RNA, 22 nt, Artificial Sequence
  Synthetic
ccccuccaaccuuguccagacc

SEQ ID NO: 11265 - RNA, 23 nt, Artificial Sequence
  Synthetic
cccccuccaaccuuguccagacc

SEQ ID NO: 11266 - RNA, 24 nt, Artificial Sequence
  Synthetic
acccccuccaaccuuguccagacc

SEQ ID NO: 11267 - RNA, 18 nt, Artificial Sequence
  Synthetic
cagccucuggcccugacc

SEQ ID NO: 11268 - RNA, 19 nt, Artificial Sequence
  Synthetic
ccagccucuggcccugacc

SEQ ID NO: 11269 - RNA, 20 nt, Artificial Sequence
  Synthetic
uccagccucuggcccugacc

SEQ ID NO: 11270 - RNA, 21 nt, Artificial Sequence
  Synthetic
cuccagccucuggcccugacc

SEQ ID NO: 11271 - RNA, 22 nt, Artificial Sequence
  Synthetic
gcuccagccucuggcccugacc

SEQ ID NO: 11272 - RNA, 23 nt, Artificial Sequence
  Synthetic
agcuccagccucuggcccugacc

SEQ ID NO: 11273 - RNA, 24 nt, Artificial Sequence
  Synthetic
cagcuccagccucuggcccugacc

SEQ ID NO: 11274 - RNA, 18 nt, Artificial Sequence
  Synthetic
ccaaccuuguccagaccc

SEQ ID NO: 11275 - RNA, 19 nt, Artificial Sequence
  Synthetic
uccaaccuuguccagaccc

SEQ ID NO: 11276 - RNA, 21 nt, Artificial Sequence
  Synthetic
ccuccaaccuuguccagaccc

SEQ ID NO: 11277 - RNA, 22 nt, Artificial Sequence
  Synthetic
cccuccaaccuuguccagaccc

SEQ ID NO: 11278 - RNA, 23 nt, Artificial Sequence
  Synthetic
ccccuccaaccuuguccagaccc

SEQ ID NO: 11279 - RNA, 24 nt, Artificial Sequence
  Synthetic
cccccuccaaccuuguccagaccc

SEQ ID NO: 11280 - RNA, 18 nt, Artificial Sequence
  Synthetic
acauaucccagagacccc

SEQ ID NO: 11281 - RNA, 19 nt, Artificial Sequence
  Synthetic
cacauaucccagagacccc

SEQ ID NO: 11282 - RNA, 20 nt, Artificial Sequence
  Synthetic
ccacauaucccagagacccc

SEQ ID NO: 11283 - RNA, 21 nt, Artificial Sequence
  Synthetic
cccacauaucccagagacccc

SEQ ID NO: 11284 - RNA, 22 nt, Artificial Sequence
  Synthetic
ccccacauaucccagagacccc

SEQ ID NO: 11285 - RNA, 23 nt, Artificial Sequence
  Synthetic
gccccacauaucccagagacccc

SEQ ID NO: 11286 - RNA, 24 nt, Artificial Sequence
  Synthetic
ugccccacauaucccagagacccc

SEQ ID NO: 11287 - RNA, 18 nt, Artificial Sequence
  Synthetic
gacacagacccggagccc

SEQ ID NO: 11288 - RNA, 19 nt, Artificial Sequence
  Synthetic
ggacacagacccggagccc

SEQ ID NO: 11289 - RNA, 21 nt, Artificial Sequence
  Synthetic
guggacacagacccggagccc

SEQ ID NO: 11290 - RNA, 22 nt, Artificial Sequence
  Synthetic
uguggacacagacccggagccc

SEQ ID NO: 11291 - RNA, 23 nt, Artificial Sequence
  Synthetic
cuguggacacagacccggagccc

SEQ ID NO: 11292 - RNA, 24 nt, Artificial Sequence
  Synthetic
acuguggacacagacccggagccc

SEQ ID NO: 11293 - RNA, 18 nt, Artificial Sequence
  Synthetic
acacgccuagacaggccc

SEQ ID NO: 11294 - RNA, 19 nt, Artificial Sequence
  Synthetic
cacacgccuagacaggccc

SEQ ID NO: 11295 - RNA, 21 nt, Artificial Sequence
  Synthetic
ggcacacgccuagacaggccc

SEQ ID NO: 11296 - RNA, 22 nt, Artificial Sequence
  Synthetic
uggcacacgccuagacaggccc

SEQ ID NO: 11297 - RNA, 23 nt, Artificial Sequence
  Synthetic
auggcacacgccuagacaggccc

SEQ ID NO: 11298 - RNA, 24 nt, Artificial Sequence
  Synthetic
cauggcacacgccuagacaggccc

SEQ ID NO: 11299 - RNA, 18 nt, Artificial Sequence
  Synthetic
gggggcuaggcggggccc

SEQ ID NO: 11300 - RNA, 19 nt, Artificial Sequence
  Synthetic
ugggggcuaggcggggccc

SEQ ID NO: 11301 - RNA, 20 nt, Artificial Sequence
  Synthetic
cugggggcuaggcggggccc

SEQ ID NO: 11302 - RNA, 21 nt, Artificial Sequence
  Synthetic
gcugggggcuaggcggggccc

SEQ ID NO: 11303 - RNA, 22 nt, Artificial Sequence
  Synthetic
agcugggggcuaggcggggccc

SEQ ID NO: 11304 - RNA, 23 nt, Artificial Sequence
  Synthetic
aagcugggggcuaggcggggccc

SEQ ID NO: 11305 - RNA, 24 nt, Artificial Sequence
  Synthetic
gaagcugggggcuaggcggggccc

SEQ ID NO: 11306 - RNA, 18 nt, Artificial Sequence
  Synthetic
cugauucugucucugccc

SEQ ID NO: 11307 - RNA, 19 nt, Artificial Sequence
  Synthetic
ccugauucugucucugccc

SEQ ID NO: 11308 - RNA, 20 nt, Artificial Sequence
  Synthetic
uccugauucugucucugccc

SEQ ID NO: 11309 - RNA, 21 nt, Artificial Sequence
  Synthetic
guccugauucugucucugccc

SEQ ID NO: 11310 - RNA, 22 nt, Artificial Sequence
  Synthetic
uguccugauucugucucugccc

SEQ ID NO: 11311 - RNA, 23 nt, Artificial Sequence
  Synthetic
guguccugauucugucucugccc

SEQ ID NO: 11312 - RNA, 24 nt, Artificial Sequence
  Synthetic
uguguccugauucugucucugccc

SEQ ID NO: 11313 - RNA, 18 nt, Artificial Sequence
  Synthetic
gaaggaaggagggcuccc

SEQ ID NO: 11314 - RNA, 19 nt, Artificial Sequence
  Synthetic
cgaaggaaggagggcuccc

SEQ ID NO: 11315 - RNA, 20 nt, Artificial Sequence
  Synthetic
ccgaaggaaggagggcuccc

SEQ ID NO: 11316 - RNA, 21 nt, Artificial Sequence
  Synthetic
uccgaaggaaggagggcuccc

SEQ ID NO: 11317 - RNA, 22 nt, Artificial Sequence
  Synthetic
uuccgaaggaaggagggcuccc

SEQ ID NO: 11318 - RNA, 23 nt, Artificial Sequence
  Synthetic
uuuccgaaggaaggagggcuccc

SEQ ID NO: 11319 - RNA, 24 nt, Artificial Sequence
  Synthetic
uuuuccgaaggaaggagggcuccc

SEQ ID NO: 11320 - RNA, 18 nt, Artificial Sequence
  Synthetic
uagaaacuccagucuccc

SEQ ID NO: 11321 - RNA, 19 nt, Artificial Sequence
  Synthetic
cuagaaacuccagucuccc

SEQ ID NO: 11322 - RNA, 20 nt, Artificial Sequence
  Synthetic
ccuagaaacuccagucuccc

SEQ ID NO: 11323 - RNA, 21 nt, Artificial Sequence
  Synthetic
cccuagaaacuccagucuccc

SEQ ID NO: 11324 - RNA, 22 nt, Artificial Sequence
  Synthetic
ccccuagaaacuccagucuccc

SEQ ID NO: 11325 - RNA, 23 nt, Artificial Sequence
  Synthetic
accccuagaaacuccagucuccc

SEQ ID NO: 11326 - RNA, 24 nt, Artificial Sequence
  Synthetic
gaccccuagaaacuccagucuccc

SEQ ID NO: 11327 - RNA, 18 nt, Artificial Sequence
  Synthetic
gccggagcugggcuuccc

SEQ ID NO: 11328 - RNA, 19 nt, Artificial Sequence
  Synthetic
ugccggagcugggcuuccc

SEQ ID NO: 11329 - RNA, 20 nt, Artificial Sequence
  Synthetic
gugccggagcugggcuuccc

SEQ ID NO: 11330 - RNA, 21 nt, Artificial Sequence
  Synthetic
agugccggagcugggcuuccc

SEQ ID NO: 11331 - RNA, 22 nt, Artificial Sequence
  Synthetic
aagugccggagcugggcuuccc

SEQ ID NO: 11332 - RNA, 23 nt, Artificial Sequence
  Synthetic
aaagugccggagcugggcuuccc

SEQ ID NO: 11333 - RNA, 24 nt, Artificial Sequence
  Synthetic
aaaagugccggagcugggcuuccc

SEQ ID NO: 11334 - RNA, 18 nt, Artificial Sequence
  Synthetic
caccuggaugugaaagcc

SEQ ID NO: 11335 - RNA, 19 nt, Artificial Sequence
  Synthetic
gcaccuggaugugaaagcc

SEQ ID NO: 11336 - RNA, 21 nt, Artificial Sequence
  Synthetic
gugcaccuggaugugaaagcc

SEQ ID NO: 11337 - RNA, 22 nt, Artificial Sequence
  Synthetic
ggugcaccuggaugugaaagcc

SEQ ID NO: 11338 - RNA, 23 nt, Artificial Sequence
  Synthetic
aggugcaccuggaugugaaagcc

SEQ ID NO: 11339 - RNA, 24 nt, Artificial Sequence
  Synthetic
caggugcaccuggaugugaaagcc

SEQ ID NO: 11340 - RNA, 18 nt, Artificial Sequence
  Synthetic
agauaagacauaagagcc

SEQ ID NO: 11341 - RNA, 19 nt, Artificial Sequence
  Synthetic
gagauaagacauaagagcc

SEQ ID NO: 11342 - RNA, 20 nt, Artificial Sequence
  Synthetic
agagauaagacauaagagcc

SEQ ID NO: 11343 - RNA, 21 nt, Artificial Sequence
  Synthetic
cagagauaagacauaagagcc

SEQ ID NO: 11344 - RNA, 22 nt, Artificial Sequence
  Synthetic
ucagagauaagacauaagagcc

SEQ ID NO: 11345 - RNA, 23 nt, Artificial Sequence
  Synthetic
cucagagauaagacauaagagcc

SEQ ID NO: 11346 - RNA, 24 nt, Artificial Sequence
  Synthetic
ucucagagauaagacauaagagcc

SEQ ID NO: 11347 - RNA, 18 nt, Artificial Sequence
  Synthetic
ggacacagacccggagcc

SEQ ID NO: 11348 - RNA, 19 nt, Artificial Sequence
  Synthetic
uggacacagacccggagcc

SEQ ID NO: 11349 - RNA, 20 nt, Artificial Sequence
  Synthetic
guggacacagacccggagcc

SEQ ID NO: 11350 - RNA, 21 nt, Artificial Sequence
  Synthetic
uguggacacagacccggagcc

SEQ ID NO: 11351 - RNA, 22 nt, Artificial Sequence
  Synthetic
cuguggacacagacccggagcc

SEQ ID NO: 11352 - RNA, 23 nt, Artificial Sequence
  Synthetic
acuguggacacagacccggagcc

SEQ ID NO: 11353 - RNA, 24 nt, Artificial Sequence
  Synthetic
cacuguggacacagacccggagcc

SEQ ID NO: 11354 - RNA, 18 nt, Artificial Sequence
  Synthetic
ccaagggcuaggggagcc

SEQ ID NO: 11355 - RNA, 19 nt, Artificial Sequence
  Synthetic
gccaagggcuaggggagcc

SEQ ID NO: 11356 - RNA, 20 nt, Artificial Sequence
  Synthetic
agccaagggcuaggggagcc

SEQ ID NO: 11357 - RNA, 21 nt, Artificial Sequence
  Synthetic
gagccaagggcuaggggagcc

SEQ ID NO: 11358 - RNA, 22 nt, Artificial Sequence
  Synthetic
agagccaagggcuaggggagcc

SEQ ID NO: 11359 - RNA, 23 nt, Artificial Sequence
  Synthetic
aagagccaagggcuaggggagcc

SEQ ID NO: 11360 - RNA, 24 nt, Artificial Sequence
  Synthetic
uaagagccaagggcuaggggagcc

SEQ ID NO: 11361 - RNA, 18 nt, Artificial Sequence
  Synthetic
cacacgccuagacaggcc

SEQ ID NO: 11362 - RNA, 19 nt, Artificial Sequence
  Synthetic
gcacacgccuagacaggcc

SEQ ID NO: 11363 - RNA, 20 nt, Artificial Sequence
  Synthetic
ggcacacgccuagacaggcc

SEQ ID NO: 11364 - RNA, 21 nt, Artificial Sequence
  Synthetic
uggcacacgccuagacaggcc

SEQ ID NO: 11365 - RNA, 22 nt, Artificial Sequence
  Synthetic
auggcacacgccuagacaggcc

SEQ ID NO: 11366 - RNA, 23 nt, Artificial Sequence
  Synthetic
cauggcacacgccuagacaggcc

SEQ ID NO: 11367 - RNA, 24 nt, Artificial Sequence
  Synthetic
gcauggcacacgccuagacaggcc

SEQ ID NO: 11368 - RNA, 18 nt, Artificial Sequence
  Synthetic
ccacugccccacauaucc

SEQ ID NO: 11369 - RNA, 19 nt, Artificial Sequence
  Synthetic
cccacugccccacauaucc

SEQ ID NO: 11370 - RNA, 20 nt, Artificial Sequence
  Synthetic
ccccacugccccacauaucc

SEQ ID NO: 11371 - RNA, 21 nt, Artificial Sequence
  Synthetic
uccccacugccccacauaucc

SEQ ID NO: 11372 - RNA, 22 nt, Artificial Sequence
  Synthetic
guccccacugccccacauaucc

SEQ ID NO: 11373 - RNA, 23 nt, Artificial Sequence
  Synthetic
uguccccacugccccacauaucc

SEQ ID NO: 11374 - RNA, 24 nt, Artificial Sequence
  Synthetic
cuguccccacugccccacauaucc

SEQ ID NO: 11375 - RNA, 18 nt, Artificial Sequence
  Synthetic
gcaagugggcagcccucc

SEQ ID NO: 11376 - RNA, 19 nt, Artificial Sequence
  Synthetic
agcaagugggcagcccucc

SEQ ID NO: 11377 - RNA, 20 nt, Artificial Sequence
  Synthetic
cagcaagugggcagcccucc

SEQ ID NO: 11378 - RNA, 21 nt, Artificial Sequence
  Synthetic
ucagcaagugggcagcccucc

SEQ ID NO: 11379 - RNA, 22 nt, Artificial Sequence
  Synthetic
cucagcaagugggcagcccucc

SEQ ID NO: 11380 - RNA, 23 nt, Artificial Sequence
  Synthetic
gcucagcaagugggcagcccucc

SEQ ID NO: 11381 - RNA, 24 nt, Artificial Sequence
  Synthetic
ggcucagcaagugggcagcccucc

SEQ ID NO: 11382 - RNA, 18 nt, Artificial Sequence
  Synthetic
ccaggacugcagggcucc

SEQ ID NO: 11383 - RNA, 19 nt, Artificial Sequence
  Synthetic
cccaggacugcagggcucc

SEQ ID NO: 11384 - RNA, 21 nt, Artificial Sequence
  Synthetic
gccccaggacugcagggcucc

SEQ ID NO: 11385 - RNA, 22 nt, Artificial Sequence
  Synthetic
ugccccaggacugcagggcucc

SEQ ID NO: 11386 - RNA, 23 nt, Artificial Sequence
  Synthetic
cugccccaggacugcagggcucc

SEQ ID NO: 11387 - RNA, 24 nt, Artificial Sequence
  Synthetic
ucugccccaggacugcagggcucc

SEQ ID NO: 11388 - RNA, 18 nt, Artificial Sequence
  Synthetic
caaagggagucugucucc

SEQ ID NO: 11389 - RNA, 19 nt, Artificial Sequence
  Synthetic
ccaaagggagucugucucc

SEQ ID NO: 11390 - RNA, 21 nt, Artificial Sequence
  Synthetic
caccaaagggagucugucucc

SEQ ID NO: 11391 - RNA, 22 nt, Artificial Sequence
  Synthetic
gcaccaaagggagucugucucc

SEQ ID NO: 11392 - RNA, 23 nt, Artificial Sequence
  Synthetic
agcaccaaagggagucugucucc

SEQ ID NO: 11393 - RNA, 24 nt, Artificial Sequence
  Synthetic
cagcaccaaagggagucugucucc

SEQ ID NO: 11394 - RNA, 18 nt, Artificial Sequence
  Synthetic
agacucaggaagccuucc

SEQ ID NO: 11395 - RNA, 19 nt, Artificial Sequence
  Synthetic
gagacucaggaagccuucc

SEQ ID NO: 11396 - RNA, 20 nt, Artificial Sequence
  Synthetic
ggagacucaggaagccuucc

SEQ ID NO: 11397 - RNA, 21 nt, Artificial Sequence
  Synthetic
aggagacucaggaagccuucc

SEQ ID NO: 11398 - RNA, 22 nt, Artificial Sequence
  Synthetic
caggagacucaggaagccuucc

SEQ ID NO: 11399 - RNA, 23 nt, Artificial Sequence
  Synthetic
gcaggagacucaggaagccuucc

SEQ ID NO: 11400 - RNA, 24 nt, Artificial Sequence
  Synthetic
ugcaggagacucaggaagccuucc

SEQ ID NO: 11401 - RNA, 18 nt, Artificial Sequence
  Synthetic
agucccaagugugcuucc

SEQ ID NO: 11402 - RNA, 19 nt, Artificial Sequence
  Synthetic
gagucccaagugugcuucc

SEQ ID NO: 11403 - RNA, 21 nt, Artificial Sequence
  Synthetic
gggagucccaagugugcuucc

SEQ ID NO: 11404 - RNA, 22 nt, Artificial Sequence
  Synthetic
ggggagucccaagugugcuucc

SEQ ID NO: 11405 - RNA, 23 nt, Artificial Sequence
  Synthetic
gggggagucccaagugugcuucc

SEQ ID NO: 11406 - RNA, 24 nt, Artificial Sequence
  Synthetic
ggggggagucccaagugugcuucc

SEQ ID NO: 11407 - RNA, 18 nt, Artificial Sequence
  Synthetic
ucccuccuccaccuuucc

SEQ ID NO: 11408 - RNA, 19 nt, Artificial Sequence
  Synthetic
cucccuccuccaccuuucc

SEQ ID NO: 11409 - RNA, 21 nt, Artificial Sequence
  Synthetic
cccucccuccuccaccuuucc

SEQ ID NO: 11410 - RNA, 22 nt, Artificial Sequence
  Synthetic
ucccucccuccuccaccuuucc

SEQ ID NO: 11411 - RNA, 23 nt, Artificial Sequence
  Synthetic
cucccucccuccuccaccuuucc

SEQ ID NO: 11412 - RNA, 24 nt, Artificial Sequence
  Synthetic
ccucccucccuccuccaccuuucc

SEQ ID NO: 11413 - RNA, 18 nt, Artificial Sequence
  Synthetic
gcaccuggaugugaaagc

SEQ ID NO: 11414 - RNA, 19 nt, Artificial Sequence
  Synthetic
ugcaccuggaugugaaagc

SEQ ID NO: 11415 - RNA, 21 nt, Artificial Sequence
  Synthetic
ggugcaccuggaugugaaagc

SEQ ID NO: 11416 - RNA, 22 nt, Artificial Sequence
  Synthetic
aggugcaccuggaugugaaagc

SEQ ID NO: 11417 - RNA, 23 nt, Artificial Sequence
  Synthetic
caggugcaccuggaugugaaagc

SEQ ID NO: 11418 - RNA, 24 nt, Artificial Sequence
  Synthetic
ucaggugcaccuggaugugaaagc

SEQ ID NO: 11419 - RNA, 18 nt, Artificial Sequence
  Synthetic
ugcugaaucuugacaagc

SEQ ID NO: 11420 - RNA, 19 nt, Artificial Sequence
  Synthetic
cugcugaaucuugacaagc

SEQ ID NO: 11421 - RNA, 20 nt, Artificial Sequence
  Synthetic
ucugcugaaucuugacaagc

SEQ ID NO: 11422 - RNA, 21 nt, Artificial Sequence
  Synthetic
cucugcugaaucuugacaagc

SEQ ID NO: 11423 - RNA, 22 nt, Artificial Sequence
  Synthetic
ucucugcugaaucuugacaagc

SEQ ID NO: 11424 - RNA, 23 nt, Artificial Sequence
  Synthetic
aucucugcugaaucuugacaagc

SEQ ID NO: 11425 - RNA, 24 nt, Artificial Sequence
  Synthetic
caucucugcugaaucuugacaagc

SEQ ID NO: 11426 - RNA, 18 nt, Artificial Sequence
  Synthetic
gaggggcccaggugaagc

SEQ ID NO: 11427 - RNA, 19 nt, Artificial Sequence
  Synthetic
ggaggggcccaggugaagc

SEQ ID NO: 11428 - RNA, 21 nt, Artificial Sequence
  Synthetic
cgggaggggcccaggugaagc

SEQ ID NO: 11429 - RNA, 22 nt, Artificial Sequence
  Synthetic
ccgggaggggcccaggugaagc

SEQ ID NO: 11430 - RNA, 23 nt, Artificial Sequence
  Synthetic
cccgggaggggcccaggugaagc

SEQ ID NO: 11431 - RNA, 24 nt, Artificial Sequence
  Synthetic
acccgggaggggcccaggugaagc

SEQ ID NO: 11432 - RNA, 18 nt, Artificial Sequence
  Synthetic
ggauccugagcccacagc

SEQ ID NO: 11433 - RNA, 19 nt, Artificial Sequence
  Synthetic
aggauccugagcccacagc

SEQ ID NO: 11434 - RNA, 20 nt, Artificial Sequence
  Synthetic
aaggauccugagcccacagc

SEQ ID NO: 11435 - RNA, 21 nt, Artificial Sequence
  Synthetic
gaaggauccugagcccacagc

SEQ ID NO: 11436 - RNA, 22 nt, Artificial Sequence
  Synthetic
agaaggauccugagcccacagc

SEQ ID NO: 11437 - RNA, 23 nt, Artificial Sequence
  Synthetic
uagaaggauccugagcccacagc

SEQ ID NO: 11438 - RNA, 24 nt, Artificial Sequence
  Synthetic
guagaaggauccugagcccacagc

SEQ ID NO: 11439 - RNA, 18 nt, Artificial Sequence
  Synthetic
agcagacaaaggcccagc

SEQ ID NO: 11440 - RNA, 19 nt, Artificial Sequence
  Synthetic
cagcagacaaaggcccagc

SEQ ID NO: 11441 - RNA, 20 nt, Artificial Sequence
  Synthetic
ccagcagacaaaggcccagc

SEQ ID NO: 11442 - RNA, 21 nt, Artificial Sequence
  Synthetic
gccagcagacaaaggcccagc

SEQ ID NO: 11443 - RNA, 22 nt, Artificial Sequence
  Synthetic
agccagcagacaaaggcccagc

SEQ ID NO: 11444 - RNA, 23 nt, Artificial Sequence
  Synthetic
aagccagcagacaaaggcccagc

SEQ ID NO: 11445 - RNA, 24 nt, Artificial Sequence
  Synthetic
caagccagcagacaaaggcccagc

SEQ ID NO: 11446 - RNA, 18 nt, Artificial Sequence
  Synthetic
ugggcaaccagaggcagc

SEQ ID NO: 11447 - RNA, 19 nt, Artificial Sequence
  Synthetic
gugggcaaccagaggcagc

SEQ ID NO: 11448 - RNA, 20 nt, Artificial Sequence
  Synthetic
ugugggcaaccagaggcagc

SEQ ID NO: 11449 - RNA, 21 nt, Artificial Sequence
  Synthetic
augugggcaaccagaggcagc

SEQ ID NO: 11450 - RNA, 22 nt, Artificial Sequence
  Synthetic
aaugugggcaaccagaggcagc

SEQ ID NO: 11451 - RNA, 23 nt, Artificial Sequence
  Synthetic
gaaugugggcaaccagaggcagc

SEQ ID NO: 11452 - RNA, 24 nt, Artificial Sequence
  Synthetic
ggaaugugggcaaccagaggcagc

SEQ ID NO: 11453 - RNA, 18 nt, Artificial Sequence
  Synthetic
cugaggaggagucagagc

SEQ ID NO: 11454 - RNA, 19 nt, Artificial Sequence
  Synthetic
gcugaggaggagucagagc

SEQ ID NO: 11455 - RNA, 21 nt, Artificial Sequence
  Synthetic
gggcugaggaggagucagagc

SEQ ID NO: 11456 - RNA, 22 nt, Artificial Sequence
  Synthetic
ggggcugaggaggagucagagc

SEQ ID NO: 11457 - RNA, 23 nt, Artificial Sequence
  Synthetic
aggggcugaggaggagucagagc

SEQ ID NO: 11458 - RNA, 24 nt, Artificial Sequence
  Synthetic
gaggggcugaggaggagucagagc

SEQ ID NO: 11459 - RNA, 18 nt, Artificial Sequence
  Synthetic
gucuccaggaaggagagc

SEQ ID NO: 11460 - RNA, 19 nt, Artificial Sequence
  Synthetic
ugucuccaggaaggagagc

SEQ ID NO: 11461 - RNA, 20 nt, Artificial Sequence
  Synthetic
cugucuccaggaaggagagc

SEQ ID NO: 11462 - RNA, 21 nt, Artificial Sequence
  Synthetic
ucugucuccaggaaggagagc

SEQ ID NO: 11463 - RNA, 22 nt, Artificial Sequence
  Synthetic
gucugucuccaggaaggagagc

SEQ ID NO: 11464 - RNA, 23 nt, Artificial Sequence
  Synthetic
agucugucuccaggaaggagagc

SEQ ID NO: 11465 - RNA, 24 nt, Artificial Sequence
  Synthetic
gagucugucuccaggaaggagagc

SEQ ID NO: 11466 - RNA, 18 nt, Artificial Sequence
  Synthetic
aagugugcuuccaggagc

SEQ ID NO: 11467 - RNA, 19 nt, Artificial Sequence
  Synthetic
caagugugcuuccaggagc

SEQ ID NO: 11468 - RNA, 20 nt, Artificial Sequence
  Synthetic
ccaagugugcuuccaggagc

SEQ ID NO: 11469 - RNA, 21 nt, Artificial Sequence
  Synthetic
cccaagugugcuuccaggagc

SEQ ID NO: 11470 - RNA, 22 nt, Artificial Sequence
  Synthetic
ucccaagugugcuuccaggagc

SEQ ID NO: 11471 - RNA, 23 nt, Artificial Sequence
  Synthetic
gucccaagugugcuuccaggagc

SEQ ID NO: 11472 - RNA, 24 nt, Artificial Sequence
  Synthetic
agucccaagugugcuuccaggagc

SEQ ID NO: 11473 - RNA, 18 nt, Artificial Sequence
  Synthetic
gagugccaaguggugagc

SEQ ID NO: 11474 - RNA, 19 nt, Artificial Sequence
  Synthetic
ggagugccaaguggugagc

SEQ ID NO: 11475 - RNA, 20 nt, Artificial Sequence
  Synthetic
uggagugccaaguggugagc

SEQ ID NO: 11476 - RNA, 21 nt, Artificial Sequence
  Synthetic
guggagugccaaguggugagc

SEQ ID NO: 11477 - RNA, 22 nt, Artificial Sequence
  Synthetic
aguggagugccaaguggugagc

SEQ ID NO: 11478 - RNA, 23 nt, Artificial Sequence
  Synthetic
gaguggagugccaaguggugagc

SEQ ID NO: 11479 - RNA, 24 nt, Artificial Sequence
  Synthetic
ggaguggagugccaaguggugagc

SEQ ID NO: 11480 - RNA, 18 nt, Artificial Sequence
  Synthetic
ggaggauguggccagcgc

SEQ ID NO: 11481 - RNA, 19 nt, Artificial Sequence
  Synthetic
gggaggauguggccagcgc

SEQ ID NO: 11482 - RNA, 21 nt, Artificial Sequence
  Synthetic
cagggaggauguggccagcgc

SEQ ID NO: 11483 - RNA, 22 nt, Artificial Sequence
  Synthetic
gcagggaggauguggccagcgc

SEQ ID NO: 11484 - RNA, 23 nt, Artificial Sequence
  Synthetic
ugcagggaggauguggccagcgc

SEQ ID NO: 11485 - RNA, 24 nt, Artificial Sequence
  Synthetic
gugcagggaggauguggccagcgc

SEQ ID NO: 11486 - RNA, 18 nt, Artificial Sequence
  Synthetic
ggcaaccagaggcagcgc

SEQ ID NO: 11487 - RNA, 19 nt, Artificial Sequence
  Synthetic
gggcaaccagaggcagcgc

SEQ ID NO: 11488 - RNA, 20 nt, Artificial Sequence
  Synthetic
ugggcaaccagaggcagcgc

SEQ ID NO: 11489 - RNA, 21 nt, Artificial Sequence
  Synthetic
gugggcaaccagaggcagcgc

SEQ ID NO: 11490 - RNA, 22 nt, Artificial Sequence
  Synthetic
ugugggcaaccagaggcagcgc

SEQ ID NO: 11491 - RNA, 23 nt, Artificial Sequence
  Synthetic
augugggcaaccagaggcagcgc

SEQ ID NO: 11492 - RNA, 24 nt, Artificial Sequence
  Synthetic
aaugugggcaaccagaggcagcgc

SEQ ID NO: 11493 - RNA, 18 nt, Artificial Sequence
  Synthetic
cuuuagacgcagacaggc

SEQ ID NO: 11494 - RNA, 19 nt, Artificial Sequence
  Synthetic
gcuuuagacgcagacaggc

SEQ ID NO: 11495 - RNA, 20 nt, Artificial Sequence
  Synthetic
ggcuuuagacgcagacaggc

SEQ ID NO: 11496 - RNA, 21 nt, Artificial Sequence
  Synthetic
gggcuuuagacgcagacaggc

SEQ ID NO: 11497 - RNA, 22 nt, Artificial Sequence
  Synthetic
ggggcuuuagacgcagacaggc

SEQ ID NO: 11498 - RNA, 23 nt, Artificial Sequence
  Synthetic
aggggcuuuagacgcagacaggc

SEQ ID NO: 11499 - RNA, 24 nt, Artificial Sequence
  Synthetic
caggggcuuuagacgcagacaggc

SEQ ID NO: 11500 - RNA, 18 nt, Artificial Sequence
  Synthetic
cacuguuggcugccaggc

SEQ ID NO: 11501 - RNA, 19 nt, Artificial Sequence
  Synthetic
acacuguuggcugccaggc

SEQ ID NO: 11502 - RNA, 20 nt, Artificial Sequence
  Synthetic
uacacuguuggcugccaggc

SEQ ID NO: 11503 - RNA, 21 nt, Artificial Sequence
  Synthetic
uuacacuguuggcugccaggc

SEQ ID NO: 11504 - RNA, 22 nt, Artificial Sequence
  Synthetic
uuuacacuguuggcugccaggc

SEQ ID NO: 11505 - RNA, 23 nt, Artificial Sequence
  Synthetic
uuuuacacuguuggcugccaggc

SEQ ID NO: 11506 - RNA, 24 nt, Artificial Sequence
  Synthetic
uuuuuacacuguuggcugccaggc

SEQ ID NO: 11507 - RNA, 18 nt, Artificial Sequence
  Synthetic
cggagcccaggaagaggc

SEQ ID NO: 11508 - RNA, 19 nt, Artificial Sequence
  Synthetic
ccggagcccaggaagaggc

SEQ ID NO: 11509 - RNA, 21 nt, Artificial Sequence
  Synthetic
acccggagcccaggaagaggc

SEQ ID NO: 11510 - RNA, 22 nt, Artificial Sequence
  Synthetic
gacccggagcccaggaagaggc

SEQ ID NO: 11511 - RNA, 23 nt, Artificial Sequence
  Synthetic
agacccggagcccaggaagaggc

SEQ ID NO: 11512 - RNA, 24 nt, Artificial Sequence
  Synthetic
cagacccggagcccaggaagaggc

SEQ ID NO: 11513 - RNA, 18 nt, Artificial Sequence
  Synthetic
gcagacaggcaaggaggc

SEQ ID NO: 11514 - RNA, 19 nt, Artificial Sequence
  Synthetic
cgcagacaggcaaggaggc

SEQ ID NO: 11515 - RNA, 21 nt, Artificial Sequence
  Synthetic
gacgcagacaggcaaggaggc

SEQ ID NO: 11516 - RNA, 22 nt, Artificial Sequence
  Synthetic
agacgcagacaggcaaggaggc

SEQ ID NO: 11517 - RNA, 23 nt, Artificial Sequence
  Synthetic
uagacgcagacaggcaaggaggc

SEQ ID NO: 11518 - RNA, 24 nt, Artificial Sequence
  Synthetic
uuagacgcagacaggcaaggaggc

SEQ ID NO: 11519 - RNA, 18 nt, Artificial Sequence
  Synthetic
gcccgcccgcuggccggc

SEQ ID NO: 11520 - RNA, 19 nt, Artificial Sequence
  Synthetic
agcccgcccgcuggccggc

SEQ ID NO: 11521 - RNA, 20 nt, Artificial Sequence
  Synthetic
gagcccgcccgcuggccggc

SEQ ID NO: 11522 - RNA, 21 nt, Artificial Sequence
  Synthetic
ggagcccgcccgcuggccggc

SEQ ID NO: 11523 - RNA, 22 nt, Artificial Sequence
  Synthetic
gggagcccgcccgcuggccggc

SEQ ID NO: 11524 - RNA, 23 nt, Artificial Sequence
  Synthetic
ggggagcccgcccgcuggccggc

SEQ ID NO: 11525 - RNA, 24 nt, Artificial Sequence
  Synthetic
uggggagcccgcccgcuggccggc

SEQ ID NO: 11526 - RNA, 18 nt, Artificial Sequence
  Synthetic
ccaggcccugcacgcggc

SEQ ID NO: 11527 - RNA, 19 nt, Artificial Sequence
  Synthetic
cccaggcccugcacgcggc

SEQ ID NO: 11528 - RNA, 21 nt, Artificial Sequence
  Synthetic
aacccaggcccugcacgcggc

SEQ ID NO: 11529 - RNA, 22 nt, Artificial Sequence
  Synthetic
caacccaggcccugcacgcggc

SEQ ID NO: 11530 - RNA, 23 nt, Artificial Sequence
  Synthetic
acaacccaggcccugcacgcggc

SEQ ID NO: 11531 - RNA, 24 nt, Artificial Sequence
  Synthetic
cacaacccaggcccugcacgcggc

SEQ ID NO: 11532 - RNA, 18 nt, Artificial Sequence
  Synthetic
aucagacccaaaaagggc

SEQ ID NO: 11533 - RNA, 19 nt, Artificial Sequence
  Synthetic
aaucagacccaaaaagggc

SEQ ID NO: 11534 - RNA, 21 nt, Artificial Sequence
  Synthetic
agaaucagacccaaaaagggc

SEQ ID NO: 11535 - RNA, 22 nt, Artificial Sequence
  Synthetic
gagaaucagacccaaaaagggc

SEQ ID NO: 11536 - RNA, 23 nt, Artificial Sequence
  Synthetic
agagaaucagacccaaaaagggc

SEQ ID NO: 11537 - RNA, 24 nt, Artificial Sequence
  Synthetic
cagagaaucagacccaaaaagggc

SEQ ID NO: 11538 - RNA, 18 nt, Artificial Sequence
  Synthetic
gacauaagagccaagggc

SEQ ID NO: 11539 - RNA, 19 nt, Artificial Sequence
  Synthetic
agacauaagagccaagggc

SEQ ID NO: 11540 - RNA, 20 nt, Artificial Sequence
  Synthetic
aagacauaagagccaagggc

SEQ ID NO: 11541 - RNA, 21 nt, Artificial Sequence
  Synthetic
uaagacauaagagccaagggc

SEQ ID NO: 11542 - RNA, 22 nt, Artificial Sequence
  Synthetic
auaagacauaagagccaagggc

SEQ ID NO: 11543 - RNA, 23 nt, Artificial Sequence
  Synthetic
gauaagacauaagagccaagggc

SEQ ID NO: 11544 - RNA, 24 nt, Artificial Sequence
  Synthetic
agauaagacauaagagccaagggc

SEQ ID NO: 11545 - RNA, 18 nt, Artificial Sequence
  Synthetic
auuaaaggugagcagggc

SEQ ID NO: 11546 - RNA, 19 nt, Artificial Sequence
  Synthetic
aauuaaaggugagcagggc

SEQ ID NO: 11547 - RNA, 21 nt, Artificial Sequence
  Synthetic
ucaauuaaaggugagcagggc

SEQ ID NO: 11548 - RNA, 22 nt, Artificial Sequence
  Synthetic
cucaauuaaaggugagcagggc

SEQ ID NO: 11549 - RNA, 23 nt, Artificial Sequence
  Synthetic
ucucaauuaaaggugagcagggc

SEQ ID NO: 11550 - RNA, 24 nt, Artificial Sequence
  Synthetic
aucucaauuaaaggugagcagggc

SEQ ID NO: 11551 - RNA, 18 nt, Artificial Sequence
  Synthetic
agaaggcggacucugggc

SEQ ID NO: 11552 - RNA, 19 nt, Artificial Sequence
  Synthetic
gagaaggcggacucugggc

SEQ ID NO: 11553 - RNA, 21 nt, Artificial Sequence
  Synthetic
cugagaaggcggacucugggc

SEQ ID NO: 11554 - RNA, 22 nt, Artificial Sequence
  Synthetic
ccugagaaggcggacucugggc

SEQ ID NO: 11555 - RNA, 23 nt, Artificial Sequence
  Synthetic
accugagaaggcggacucugggc

SEQ ID NO: 11556 - RNA, 24 nt, Artificial Sequence
  Synthetic
gaccugagaaggcggacucugggc

SEQ ID NO: 11557 - RNA, 18 nt, Artificial Sequence
  Synthetic
caggugcagcggccuggc

SEQ ID NO: 11558 - RNA, 19 nt, Artificial Sequence
  Synthetic
acaggugcagcggccuggc

SEQ ID NO: 11559 - RNA, 21 nt, Artificial Sequence
  Synthetic
ugacaggugcagcggccuggc

SEQ ID NO: 11560 - RNA, 22 nt, Artificial Sequence
  Synthetic
cugacaggugcagcggccuggc

SEQ ID NO: 11561 - RNA, 23 nt, Artificial Sequence
  Synthetic
ccugacaggugcagcggccuggc

SEQ ID NO: 11562 - RNA, 24 nt, Artificial Sequence
  Synthetic
accugacaggugcagcggccuggc

SEQ ID NO: 11563 - RNA, 18 nt, Artificial Sequence
  Synthetic
cuauuugccagcucaugc

SEQ ID NO: 11564 - RNA, 19 nt, Artificial Sequence
  Synthetic
ucuauuugccagcucaugc

SEQ ID NO: 11565 - RNA, 20 nt, Artificial Sequence
  Synthetic
uucuauuugccagcucaugc

SEQ ID NO: 11566 - RNA, 21 nt, Artificial Sequence
  Synthetic
uuucuauuugccagcucaugc

SEQ ID NO: 11567 - RNA, 22 nt, Artificial Sequence
  Synthetic
uuuucuauuugccagcucaugc

SEQ ID NO: 11568 - RNA, 23 nt, Artificial Sequence
  Synthetic
cuuuucuauuugccagcucaugc

SEQ ID NO: 11569 - RNA, 24 nt, Artificial Sequence
  Synthetic
ccuuuucuauuugccagcucaugc

SEQ ID NO: 11570 - RNA, 18 nt, Artificial Sequence
  Synthetic
agccuaggggcucacugc

SEQ ID NO: 11571 - RNA, 19 nt, Artificial Sequence
  Synthetic
gagccuaggggcucacugc

SEQ ID NO: 11572 - RNA, 21 nt, Artificial Sequence
  Synthetic
gggagccuaggggcucacugc

SEQ ID NO: 11573 - RNA, 22 nt, Artificial Sequence
  Synthetic
ggggagccuaggggcucacugc

SEQ ID NO: 11574 - RNA, 23 nt, Artificial Sequence
  Synthetic
aggggagccuaggggcucacugc

SEQ ID NO: 11575 - RNA, 24 nt, Artificial Sequence
  Synthetic
uaggggagccuaggggcucacugc

SEQ ID NO: 11576 - RNA, 18 nt, Artificial Sequence
  Synthetic
aguuggggccaaaagugc

SEQ ID NO: 11577 - RNA, 19 nt, Artificial Sequence
  Synthetic
gaguuggggccaaaagugc

SEQ ID NO: 11578 - RNA, 21 nt, Artificial Sequence
  Synthetic
gggaguuggggccaaaagugc

SEQ ID NO: 11579 - RNA, 22 nt, Artificial Sequence
  Synthetic
cgggaguuggggccaaaagugc

SEQ ID NO: 11580 - RNA, 23 nt, Artificial Sequence
  Synthetic
gcgggaguuggggccaaaagugc

SEQ ID NO: 11581 - RNA, 24 nt, Artificial Sequence
  Synthetic
ugcgggaguuggggccaaaagugc

SEQ ID NO: 11582 - RNA, 18 nt, Artificial Sequence
  Synthetic
agcaggcacugaaggugc

SEQ ID NO: 11583 - RNA, 19 nt, Artificial Sequence
  Synthetic
aagcaggcacugaaggugc

SEQ ID NO: 11584 - RNA, 21 nt, Artificial Sequence
  Synthetic
gaaagcaggcacugaaggugc

SEQ ID NO: 11585 - RNA, 22 nt, Artificial Sequence
  Synthetic
ggaaagcaggcacugaaggugc

SEQ ID NO: 11586 - RNA, 23 nt, Artificial Sequence
  Synthetic
gggaaagcaggcacugaaggugc

SEQ ID NO: 11587 - RNA, 24 nt, Artificial Sequence
  Synthetic
agggaaagcaggcacugaaggugc

SEQ ID NO: 11588 - RNA, 18 nt, Artificial Sequence
  Synthetic
ugaacaaguagaaggauc

SEQ ID NO: 11589 - RNA, 19 nt, Artificial Sequence
  Synthetic
cugaacaaguagaaggauc

SEQ ID NO: 11590 - RNA, 20 nt, Artificial Sequence
  Synthetic
ucugaacaaguagaaggauc

SEQ ID NO: 11591 - RNA, 21 nt, Artificial Sequence
  Synthetic
aucugaacaaguagaaggauc

SEQ ID NO: 11592 - RNA, 22 nt, Artificial Sequence
  Synthetic
gaucugaacaaguagaaggauc

SEQ ID NO: 11593 - RNA, 23 nt, Artificial Sequence
  Synthetic
agaucugaacaaguagaaggauc

SEQ ID NO: 11594 - RNA, 24 nt, Artificial Sequence
  Synthetic
aagaucugaacaaguagaaggauc

SEQ ID NO: 11595 - RNA, 18 nt, Artificial Sequence
  Synthetic
gcaaauaguuuucauauc

SEQ ID NO: 11596 - RNA, 19 nt, Artificial Sequence
  Synthetic
ggcaaauaguuuucauauc

SEQ ID NO: 11597 - RNA, 20 nt, Artificial Sequence
  Synthetic
uggcaaauaguuuucauauc

SEQ ID NO: 11598 - RNA, 21 nt, Artificial Sequence
  Synthetic
auggcaaauaguuuucauauc

SEQ ID NO: 11599 - RNA, 22 nt, Artificial Sequence
  Synthetic
cauggcaaauaguuuucauauc

SEQ ID NO: 11600 - RNA, 23 nt, Artificial Sequence
  Synthetic
gcauggcaaauaguuuucauauc

SEQ ID NO: 11601 - RNA, 24 nt, Artificial Sequence
  Synthetic
agcauggcaaauaguuuucauauc

SEQ ID NO: 11602 - RNA, 18 nt, Artificial Sequence
  Synthetic
acuuccugagacagacuc

SEQ ID NO: 11603 - RNA, 19 nt, Artificial Sequence
  Synthetic
uacuuccugagacagacuc

SEQ ID NO: 11604 - RNA, 20 nt, Artificial Sequence
  Synthetic
uuacuuccugagacagacuc

SEQ ID NO: 11605 - RNA, 21 nt, Artificial Sequence
  Synthetic
uuuacuuccugagacagacuc

SEQ ID NO: 11606 - RNA, 22 nt, Artificial Sequence
  Synthetic
auuuacuuccugagacagacuc

SEQ ID NO: 11607 - RNA, 23 nt, Artificial Sequence
  Synthetic
cauuuacuuccugagacagacuc

SEQ ID NO: 11608 - RNA, 24 nt, Artificial Sequence
  Synthetic
ccauuuacuuccugagacagacuc

SEQ ID NO: 11609 - RNA, 18 nt, Artificial Sequence
  Synthetic
gcucacugcaggagacuc

SEQ ID NO: 11610 - RNA, 19 nt, Artificial Sequence
  Synthetic
ggcucacugcaggagacuc

SEQ ID NO: 11611 - RNA, 21 nt, Artificial Sequence
  Synthetic
ggggcucacugcaggagacuc

SEQ ID NO: 11612 - RNA, 22 nt, Artificial Sequence
  Synthetic
aggggcucacugcaggagacuc

SEQ ID NO: 11613 - RNA, 23 nt, Artificial Sequence
  Synthetic
uaggggcucacugcaggagacuc

SEQ ID NO: 11614 - RNA, 24 nt, Artificial Sequence
  Synthetic
cuaggggcucacugcaggagacuc

SEQ ID NO: 11615 - RNA, 18 nt, Artificial Sequence
  Synthetic
aagggcuggaggagacuc

SEQ ID NO: 11616 - RNA, 19 nt, Artificial Sequence
  Synthetic
aaagggcuggaggagacuc

SEQ ID NO: 11617 - RNA, 21 nt, Artificial Sequence
  Synthetic
aaaaagggcuggaggagacuc

SEQ ID NO: 11618 - RNA, 22 nt, Artificial Sequence
  Synthetic
caaaaagggcuggaggagacuc

SEQ ID NO: 11619 - RNA, 23 nt, Artificial Sequence
  Synthetic
ccaaaaagggcuggaggagacuc

SEQ ID NO: 11620 - RNA, 24 nt, Artificial Sequence
  Synthetic
cccaaaaagggcuggaggagacuc

SEQ ID NO: 11621 - RNA, 18 nt, Artificial Sequence
  Synthetic
agaauucuccuccuccuc

SEQ ID NO: 11622 - RNA, 19 nt, Artificial Sequence
  Synthetic
cagaauucuccuccuccuc

SEQ ID NO: 11623 - RNA, 21 nt, Artificial Sequence
  Synthetic
uucagaauucuccuccuccuc

SEQ ID NO: 11624 - RNA, 22 nt, Artificial Sequence
  Synthetic
auucagaauucuccuccuccuc

SEQ ID NO: 11625 - RNA, 23 nt, Artificial Sequence
  Synthetic
aauucagaauucuccuccuccuc

SEQ ID NO: 11626 - RNA, 24 nt, Artificial Sequence
  Synthetic
gaauucagaauucuccuccuccuc

SEQ ID NO: 11627 - RNA, 18 nt, Artificial Sequence
  Synthetic
gaaggcugccgcuuccuc

SEQ ID NO: 11628 - RNA, 19 nt, Artificial Sequence
  Synthetic
ggaaggcugccgcuuccuc

SEQ ID NO: 11629 - RNA, 20 nt, Artificial Sequence
  Synthetic
gggaaggcugccgcuuccuc

SEQ ID NO: 11630 - RNA, 21 nt, Artificial Sequence
  Synthetic
agggaaggcugccgcuuccuc

SEQ ID NO: 11631 - RNA, 22 nt, Artificial Sequence
  Synthetic
cagggaaggcugccgcuuccuc

SEQ ID NO: 11632 - RNA, 23 nt, Artificial Sequence
  Synthetic
gcagggaaggcugccgcuuccuc

SEQ ID NO: 11633 - RNA, 24 nt, Artificial Sequence
  Synthetic
ggcagggaaggcugccgcuuccuc

SEQ ID NO: 11634 - RNA, 18 nt, Artificial Sequence
  Synthetic
cccaggacugcagggcuc

SEQ ID NO: 11635 - RNA, 19 nt, Artificial Sequence
  Synthetic
ccccaggacugcagggcuc

SEQ ID NO: 11636 - RNA, 20 nt, Artificial Sequence
  Synthetic
gccccaggacugcagggcuc

SEQ ID NO: 11637 - RNA, 21 nt, Artificial Sequence
  Synthetic
ugccccaggacugcagggcuc

SEQ ID NO: 11638 - RNA, 22 nt, Artificial Sequence
  Synthetic
cugccccaggacugcagggcuc

SEQ ID NO: 11639 - RNA, 23 nt, Artificial Sequence
  Synthetic
ucugccccaggacugcagggcuc

SEQ ID NO: 11640 - RNA, 24 nt, Artificial Sequence
  Synthetic
cucugccccaggacugcagggcuc

SEQ ID NO: 11641 - RNA, 18 nt, Artificial Sequence
  Synthetic
ccgaaggaaggagggcuc

SEQ ID NO: 11642 - RNA, 19 nt, Artificial Sequence
  Synthetic
uccgaaggaaggagggcuc

SEQ ID NO: 11643 - RNA, 20 nt, Artificial Sequence
  Synthetic
uuccgaaggaaggagggcuc

SEQ ID NO: 11644 - RNA, 21 nt, Artificial Sequence
  Synthetic
uuuccgaaggaaggagggcuc

SEQ ID NO: 11645 - RNA, 22 nt, Artificial Sequence
  Synthetic
uuuuccgaaggaaggagggcuc

SEQ ID NO: 11646 - RNA, 23 nt, Artificial Sequence
  Synthetic
guuuuccgaaggaaggagggcuc

SEQ ID NO: 11647 - RNA, 24 nt, Artificial Sequence
  Synthetic
aguuuuccgaaggaaggagggcuc

SEQ ID NO: 11648 - RNA, 18 nt, Artificial Sequence
  Synthetic
ccaaagggagucugucuc

SEQ ID NO: 11649 - RNA, 19 nt, Artificial Sequence
  Synthetic
accaaagggagucugucuc

SEQ ID NO: 11650 - RNA, 20 nt, Artificial Sequence
  Synthetic
caccaaagggagucugucuc

SEQ ID NO: 11651 - RNA, 21 nt, Artificial Sequence
  Synthetic
gcaccaaagggagucugucuc

SEQ ID NO: 11652 - RNA, 22 nt, Artificial Sequence
  Synthetic
agcaccaaagggagucugucuc

SEQ ID NO: 11653 - RNA, 23 nt, Artificial Sequence
  Synthetic
cagcaccaaagggagucugucuc

SEQ ID NO: 11654 - RNA, 24 nt, Artificial Sequence
  Synthetic
ccagcaccaaagggagucugucuc

SEQ ID NO: 11655 - RNA, 18 nt, Artificial Sequence
  Synthetic
gcuuuugccauuuacuuc

SEQ ID NO: 11656 - RNA, 19 nt, Artificial Sequence
  Synthetic
cgcuuuugccauuuacuuc

SEQ ID NO: 11657 - RNA, 20 nt, Artificial Sequence
  Synthetic
gcgcuuuugccauuuacuuc

SEQ ID NO: 11658 - RNA, 21 nt, Artificial Sequence
  Synthetic
agcgcuuuugccauuuacuuc

SEQ ID NO: 11659 - RNA, 22 nt, Artificial Sequence
  Synthetic
uagcgcuuuugccauuuacuuc

SEQ ID NO: 11660 - RNA, 23 nt, Artificial Sequence
  Synthetic
uuagcgcuuuugccauuuacuuc

SEQ ID NO: 11661 - RNA, 24 nt, Artificial Sequence
  Synthetic
cuuagcgcuuuugccauuuacuuc

SEQ ID NO: 11662 - RNA, 18 nt, Artificial Sequence
  Synthetic
gagucccaagugugcuuc

SEQ ID NO: 11663 - RNA, 19 nt, Artificial Sequence
  Synthetic
ggagucccaagugugcuuc

SEQ ID NO: 11664 - RNA, 20 nt, Artificial Sequence
  Synthetic
gggagucccaagugugcuuc

SEQ ID NO: 11665 - RNA, 21 nt, Artificial Sequence
  Synthetic
ggggagucccaagugugcuuc

SEQ ID NO: 11666 - RNA, 22 nt, Artificial Sequence
  Synthetic
gggggagucccaagugugcuuc

SEQ ID NO: 11667 - RNA, 23 nt, Artificial Sequence
  Synthetic
ggggggagucccaagugugcuuc

SEQ ID NO: 11668 - RNA, 24 nt, Artificial Sequence
  Synthetic
aggggggagucccaagugugcuuc

SEQ ID NO: 11669 - RNA, 18 nt, Artificial Sequence
  Synthetic
cucccuccuccaccuuuc

SEQ ID NO: 11670 - RNA, 19 nt, Artificial Sequence
  Synthetic
ccucccuccuccaccuuuc

SEQ ID NO: 11671 - RNA, 20 nt, Artificial Sequence
  Synthetic
cccucccuccuccaccuuuc

SEQ ID NO: 11672 - RNA, 21 nt, Artificial Sequence
  Synthetic
ucccucccuccuccaccuuuc

SEQ ID NO: 11673 - RNA, 22 nt, Artificial Sequence
  Synthetic
cucccucccuccuccaccuuuc

SEQ ID NO: 11674 - RNA, 23 nt, Artificial Sequence
  Synthetic
ccucccucccuccuccaccuuuc

SEQ ID NO: 11675 - RNA, 24 nt, Artificial Sequence
  Synthetic
uccucccucccuccuccaccuuuc

SEQ ID NO: 11676 - RNA, 18 nt, Artificial Sequence
  Synthetic
ggaguuuagcaggcaaag

SEQ ID NO: 11677 - RNA, 19 nt, Artificial Sequence
  Synthetic
aggaguuuagcaggcaaag

SEQ ID NO: 11678 - RNA, 20 nt, Artificial Sequence
  Synthetic
aaggaguuuagcaggcaaag

SEQ ID NO: 11679 - RNA, 21 nt, Artificial Sequence
  Synthetic
caaggaguuuagcaggcaaag

SEQ ID NO: 11680 - RNA, 22 nt, Artificial Sequence
  Synthetic
gcaaggaguuuagcaggcaaag

SEQ ID NO: 11681 - RNA, 23 nt, Artificial Sequence
  Synthetic
agcaaggaguuuagcaggcaaag

SEQ ID NO: 11682 - RNA, 24 nt, Artificial Sequence
  Synthetic
aagcaaggaguuuagcaggcaaag

SEQ ID NO: 11683 - RNA, 18 nt, Artificial Sequence
  Synthetic
ggacaggagggcagaaag

SEQ ID NO: 11684 - RNA, 19 nt, Artificial Sequence
  Synthetic
aggacaggagggcagaaag

SEQ ID NO: 11685 - RNA, 21 nt, Artificial Sequence
  Synthetic
ggaggacaggagggcagaaag

SEQ ID NO: 11686 - RNA, 22 nt, Artificial Sequence
  Synthetic
gggaggacaggagggcagaaag

SEQ ID NO: 11687 - RNA, 23 nt, Artificial Sequence
  Synthetic
cgggaggacaggagggcagaaag

SEQ ID NO: 11688 - RNA, 24 nt, Artificial Sequence
  Synthetic
ccgggaggacaggagggcagaaag

SEQ ID NO: 11689 - RNA, 18 nt, Artificial Sequence
  Synthetic
ugcaccuggaugugaaag

SEQ ID NO: 11690 - RNA, 19 nt, Artificial Sequence
  Synthetic
gugcaccuggaugugaaag

SEQ ID NO: 11691 - RNA, 20 nt, Artificial Sequence
  Synthetic
ggugcaccuggaugugaaag

SEQ ID NO: 11692 - RNA, 21 nt, Artificial Sequence
  Synthetic
aggugcaccuggaugugaaag

SEQ ID NO: 11693 - RNA, 22 nt, Artificial Sequence
  Synthetic
caggugcaccuggaugugaaag

SEQ ID NO: 11694 - RNA, 23 nt, Artificial Sequence
  Synthetic
ucaggugcaccuggaugugaaag

SEQ ID NO: 11695 - RNA, 24 nt, Artificial Sequence
  Synthetic
cucaggugcaccuggaugugaaag

SEQ ID NO: 11696 - RNA, 18 nt, Artificial Sequence
  Synthetic
uuagcaucucaauuaaag

SEQ ID NO: 11697 - RNA, 19 nt, Artificial Sequence
  Synthetic
auuagcaucucaauuaaag

SEQ ID NO: 11698 - RNA, 20 nt, Artificial Sequence
  Synthetic
cauuagcaucucaauuaaag

SEQ ID NO: 11699 - RNA, 21 nt, Artificial Sequence
  Synthetic
ucauuagcaucucaauuaaag

SEQ ID NO: 11700 - RNA, 22 nt, Artificial Sequence
  Synthetic
cucauuagcaucucaauuaaag

SEQ ID NO: 11701 - RNA, 23 nt, Artificial Sequence
  Synthetic
ucucauuagcaucucaauuaaag

SEQ ID NO: 11702 - RNA, 24 nt, Artificial Sequence
  Synthetic
aucucauuagcaucucaauuaaag

SEQ ID NO: 11703 - RNA, 18 nt, Artificial Sequence
  Synthetic
ggcaaagaucugaacaag

SEQ ID NO: 11704 - RNA, 19 nt, Artificial Sequence
  Synthetic
gggcaaagaucugaacaag

SEQ ID NO: 11705 - RNA, 20 nt, Artificial Sequence
  Synthetic
ggggcaaagaucugaacaag

SEQ ID NO: 11706 - RNA, 21 nt, Artificial Sequence
  Synthetic
aggggcaaagaucugaacaag

SEQ ID NO: 11707 - RNA, 22 nt, Artificial Sequence
  Synthetic
gaggggcaaagaucugaacaag

SEQ ID NO: 11708 - RNA, 23 nt, Artificial Sequence
  Synthetic
ugaggggcaaagaucugaacaag

SEQ ID NO: 11709 - RNA, 24 nt, Artificial Sequence
  Synthetic
gugaggggcaaagaucugaacaag

SEQ ID NO: 11710 - RNA, 18 nt, Artificial Sequence
  Synthetic
cuaggagggcaacacaag

SEQ ID NO: 11711 - RNA, 19 nt, Artificial Sequence
  Synthetic
gcuaggagggcaacacaag

SEQ ID NO: 11712 - RNA, 20 nt, Artificial Sequence
  Synthetic
agcuaggagggcaacacaag

SEQ ID NO: 11713 - RNA, 21 nt, Artificial Sequence
  Synthetic
cagcuaggagggcaacacaag

SEQ ID NO: 11714 - RNA, 22 nt, Artificial Sequence
  Synthetic
acagcuaggagggcaacacaag

SEQ ID NO: 11715 - RNA, 23 nt, Artificial Sequence
  Synthetic
cacagcuaggagggcaacacaag

SEQ ID NO: 11716 - RNA, 24 nt, Artificial Sequence
  Synthetic
ccacagcuaggagggcaacacaag

SEQ ID NO: 11717 - RNA, 18 nt, Artificial Sequence
  Synthetic
uccaggaaggagagcaag

SEQ ID NO: 11718 - RNA, 19 nt, Artificial Sequence
  Synthetic
cuccaggaaggagagcaag

SEQ ID NO: 11719 - RNA, 21 nt, Artificial Sequence
  Synthetic
gucuccaggaaggagagcaag

SEQ ID NO: 11720 - RNA, 22 nt, Artificial Sequence
  Synthetic
ugucuccaggaaggagagcaag

SEQ ID NO: 11721 - RNA, 23 nt, Artificial Sequence
  Synthetic
cugucuccaggaaggagagcaag

SEQ ID NO: 11722 - RNA, 24 nt, Artificial Sequence
  Synthetic
ucugucuccaggaaggagagcaag

SEQ ID NO: 11723 - RNA, 18 nt, Artificial Sequence
  Synthetic
ugccaaguggugagcaag

SEQ ID NO: 11724 - RNA, 19 nt, Artificial Sequence
  Synthetic
gugccaaguggugagcaag

SEQ ID NO: 11725 - RNA, 20 nt, Artificial Sequence
  Synthetic
agugccaaguggugagcaag

SEQ ID NO: 11726 - RNA, 21 nt, Artificial Sequence
  Synthetic
gagugccaaguggugagcaag

SEQ ID NO: 11727 - RNA, 22 nt, Artificial Sequence
  Synthetic
ggagugccaaguggugagcaag

SEQ ID NO: 11728 - RNA, 23 nt, Artificial Sequence
  Synthetic
uggagugccaaguggugagcaag

SEQ ID NO: 11729 - RNA, 24 nt, Artificial Sequence
  Synthetic
guggagugccaaguggugagcaag

SEQ ID NO: 11730 - RNA, 18 nt, Artificial Sequence
  Synthetic
aguacuggaccugagaag

SEQ ID NO: 11731 - RNA, 19 nt, Artificial Sequence
  Synthetic
gaguacuggaccugagaag

SEQ ID NO: 11732 - RNA, 20 nt, Artificial Sequence
  Synthetic
ggaguacuggaccugagaag

SEQ ID NO: 11733 - RNA, 21 nt, Artificial Sequence
  Synthetic
gggaguacuggaccugagaag

SEQ ID NO: 11734 - RNA, 22 nt, Artificial Sequence
  Synthetic
ugggaguacuggaccugagaag

SEQ ID NO: 11735 - RNA, 23 nt, Artificial Sequence
  Synthetic
cugggaguacuggaccugagaag

SEQ ID NO: 11736 - RNA, 24 nt, Artificial Sequence
  Synthetic
acugggaguacuggaccugagaag

SEQ ID NO: 11737 - RNA, 18 nt, Artificial Sequence
  Synthetic
ggaguuuuccgaaggaag

SEQ ID NO: 11738 - RNA, 19 nt, Artificial Sequence
  Synthetic
gggaguuuuccgaaggaag

SEQ ID NO: 11739 - RNA, 20 nt, Artificial Sequence
  Synthetic
cgggaguuuuccgaaggaag

SEQ ID NO: 11740 - RNA, 21 nt, Artificial Sequence
  Synthetic
ccgggaguuuuccgaaggaag

SEQ ID NO: 11741 - RNA, 22 nt, Artificial Sequence
  Synthetic
gccgggaguuuuccgaaggaag

SEQ ID NO: 11742 - RNA, 23 nt, Artificial Sequence
  Synthetic
agccgggaguuuuccgaaggaag

SEQ ID NO: 11743 - RNA, 24 nt, Artificial Sequence
  Synthetic
gagccgggaguuuuccgaaggaag

SEQ ID NO: 11744 - RNA, 18 nt, Artificial Sequence
  Synthetic
gagucugucuccaggaag

SEQ ID NO: 11745 - RNA, 19 nt, Artificial Sequence
  Synthetic
ggagucugucuccaggaag

SEQ ID NO: 11746 - RNA, 20 nt, Artificial Sequence
  Synthetic
gggagucugucuccaggaag

SEQ ID NO: 11747 - RNA, 21 nt, Artificial Sequence
  Synthetic
agggagucugucuccaggaag

SEQ ID NO: 11748 - RNA, 22 nt, Artificial Sequence
  Synthetic
aagggagucugucuccaggaag

SEQ ID NO: 11749 - RNA, 23 nt, Artificial Sequence
  Synthetic
aaagggagucugucuccaggaag

SEQ ID NO: 11750 - RNA, 24 nt, Artificial Sequence
  Synthetic
caaagggagucugucuccaggaag

SEQ ID NO: 11751 - RNA, 18 nt, Artificial Sequence
  Synthetic
ggaggggcccaggugaag

SEQ ID NO: 11752 - RNA, 19 nt, Artificial Sequence
  Synthetic
gggaggggcccaggugaag

SEQ ID NO: 11753 - RNA, 20 nt, Artificial Sequence
  Synthetic
cgggaggggcccaggugaag

SEQ ID NO: 11754 - RNA, 21 nt, Artificial Sequence
  Synthetic
ccgggaggggcccaggugaag

SEQ ID NO: 11755 - RNA, 22 nt, Artificial Sequence
  Synthetic
cccgggaggggcccaggugaag

SEQ ID NO: 11756 - RNA, 23 nt, Artificial Sequence
  Synthetic
acccgggaggggcccaggugaag

SEQ ID NO: 11757 - RNA, 24 nt, Artificial Sequence
  Synthetic
gacccgggaggggcccaggugaag

SEQ ID NO: 11758 - RNA, 18 nt, Artificial Sequence
  Synthetic
uccuccccgcucacuaag

SEQ ID NO: 11759 - RNA, 19 nt, Artificial Sequence
  Synthetic
cuccuccccgcucacuaag

SEQ ID NO: 11760 - RNA, 21 nt, Artificial Sequence
  Synthetic
gucuccuccccgcucacuaag

SEQ ID NO: 11761 - RNA, 22 nt, Artificial Sequence
  Synthetic
ggucuccuccccgcucacuaag

SEQ ID NO: 11762 - RNA, 23 nt, Artificial Sequence
  Synthetic
aggucuccuccccgcucacuaag

SEQ ID NO: 11763 - RNA, 24 nt, Artificial Sequence
  Synthetic
caggucuccuccccgcucacuaag

SEQ ID NO: 11764 - RNA, 18 nt, Artificial Sequence
  Synthetic
ggggaaccgggaggacag

SEQ ID NO: 11765 - RNA, 19 nt, Artificial Sequence
  Synthetic
uggggaaccgggaggacag

SEQ ID NO: 11766 - RNA, 20 nt, Artificial Sequence
  Synthetic
guggggaaccgggaggacag

SEQ ID NO: 11767 - RNA, 21 nt, Artificial Sequence
  Synthetic
gguggggaaccgggaggacag

SEQ ID NO: 11768 - RNA, 22 nt, Artificial Sequence
  Synthetic
ggguggggaaccgggaggacag

SEQ ID NO: 11769 - RNA, 23 nt, Artificial Sequence
  Synthetic
uggguggggaaccgggaggacag

SEQ ID NO: 11770 - RNA, 24 nt, Artificial Sequence
  Synthetic
cuggguggggaaccgggaggacag

SEQ ID NO: 11771 - RNA, 18 nt, Artificial Sequence
  Synthetic
gacccgggaggggcccag

SEQ ID NO: 11772 - RNA, 19 nt, Artificial Sequence
  Synthetic
agacccgggaggggcccag

SEQ ID NO: 11773 - RNA, 20 nt, Artificial Sequence
  Synthetic
cagacccgggaggggcccag

SEQ ID NO: 11774 - RNA, 21 nt, Artificial Sequence
  Synthetic
ccagacccgggaggggcccag

SEQ ID NO: 11775 - RNA, 22 nt, Artificial Sequence
  Synthetic
uccagacccgggaggggcccag

SEQ ID NO: 11776 - RNA, 23 nt, Artificial Sequence
  Synthetic
guccagacccgggaggggcccag

SEQ ID NO: 11777 - RNA, 24 nt, Artificial Sequence
  Synthetic
uguccagacccgggaggggcccag

SEQ ID NO: 11778 - RNA, 18 nt, Artificial Sequence
  Synthetic
cugagugaguagaggcag

SEQ ID NO: 11779 - RNA, 19 nt, Artificial Sequence
  Synthetic
acugagugaguagaggcag

SEQ ID NO: 11780 - RNA, 20 nt, Artificial Sequence
  Synthetic
cacugagugaguagaggcag

SEQ ID NO: 11781 - RNA, 21 nt, Artificial Sequence
  Synthetic
gcacugagugaguagaggcag

SEQ ID NO: 11782 - RNA, 22 nt, Artificial Sequence
  Synthetic
ggcacugagugaguagaggcag

SEQ ID NO: 11783 - RNA, 23 nt, Artificial Sequence
  Synthetic
gggcacugagugaguagaggcag

SEQ ID NO: 11784 - RNA, 24 nt, Artificial Sequence
  Synthetic
ggggcacugagugaguagaggcag

SEQ ID NO: 11785 - RNA, 18 nt, Artificial Sequence
  Synthetic
gagggcucccgagggcag

SEQ ID NO: 11786 - RNA, 19 nt, Artificial Sequence
  Synthetic
ggagggcucccgagggcag

SEQ ID NO: 11787 - RNA, 20 nt, Artificial Sequence
  Synthetic
aggagggcucccgagggcag

SEQ ID NO: 11788 - RNA, 21 nt, Artificial Sequence
  Synthetic
aaggagggcucccgagggcag

SEQ ID NO: 11789 - RNA, 22 nt, Artificial Sequence
  Synthetic
gaaggagggcucccgagggcag

SEQ ID NO: 11790 - RNA, 23 nt, Artificial Sequence
  Synthetic
ggaaggagggcucccgagggcag

SEQ ID NO: 11791 - RNA, 24 nt, Artificial Sequence
  Synthetic
aggaaggagggcucccgagggcag

SEQ ID NO: 11792 - RNA, 18 nt, Artificial Sequence
  Synthetic
ugggggacaggauggcag

SEQ ID NO: 11793 - RNA, 19 nt, Artificial Sequence
  Synthetic
cugggggacaggauggcag

SEQ ID NO: 11794 - RNA, 20 nt, Artificial Sequence
  Synthetic
gcugggggacaggauggcag

SEQ ID NO: 11795 - RNA, 21 nt, Artificial Sequence
  Synthetic
ggcugggggacaggauggcag

SEQ ID NO: 11796 - RNA, 22 nt, Artificial Sequence
  Synthetic
aggcugggggacaggauggcag

SEQ ID NO: 11797 - RNA, 23 nt, Artificial Sequence
  Synthetic
gaggcugggggacaggauggcag

SEQ ID NO: 11798 - RNA, 24 nt, Artificial Sequence
  Synthetic
ggaggcugggggacaggauggcag

SEQ ID NO: 11799 - RNA, 18 nt, Artificial Sequence
  Synthetic
ugggagcagcgcacucag

SEQ ID NO: 11800 - RNA, 19 nt, Artificial Sequence
  Synthetic
gugggagcagcgcacucag

SEQ ID NO: 11801 - RNA, 20 nt, Artificial Sequence
  Synthetic
agugggagcagcgcacucag

SEQ ID NO: 11802 - RNA, 21 nt, Artificial Sequence
  Synthetic
aagugggagcagcgcacucag

SEQ ID NO: 11803 - RNA, 22 nt, Artificial Sequence
  Synthetic
uaagugggagcagcgcacucag

SEQ ID NO: 11804 - RNA, 23 nt, Artificial Sequence
  Synthetic
cuaagugggagcagcgcacucag

SEQ ID NO: 11805 - RNA, 24 nt, Artificial Sequence
  Synthetic
acuaagugggagcagcgcacucag

SEQ ID NO: 11806 - RNA, 18 nt, Artificial Sequence
  Synthetic
cccucaggcccugcagag

SEQ ID NO: 11807 - RNA, 19 nt, Artificial Sequence
  Synthetic
acccucaggcccugcagag

SEQ ID NO: 11808 - RNA, 20 nt, Artificial Sequence
  Synthetic
cacccucaggcccugcagag

SEQ ID NO: 11809 - RNA, 21 nt, Artificial Sequence
  Synthetic
ucacccucaggcccugcagag

SEQ ID NO: 11810 - RNA, 22 nt, Artificial Sequence
  Synthetic
cucacccucaggcccugcagag

SEQ ID NO: 11811 - RNA, 23 nt, Artificial Sequence
  Synthetic
ccucacccucaggcccugcagag

SEQ ID NO: 11812 - RNA, 24 nt, Artificial Sequence
  Synthetic
gccucacccucaggcccugcagag

SEQ ID NO: 11813 - RNA, 18 nt, Artificial Sequence
  Synthetic
gcugaggaggagucagag

SEQ ID NO: 11814 - RNA, 19 nt, Artificial Sequence
  Synthetic
ggcugaggaggagucagag

SEQ ID NO: 11815 - RNA, 20 nt, Artificial Sequence
  Synthetic
gggcugaggaggagucagag

SEQ ID NO: 11816 - RNA, 21 nt, Artificial Sequence
  Synthetic
ggggcugaggaggagucagag

SEQ ID NO: 11817 - RNA, 22 nt, Artificial Sequence
  Synthetic
aggggcugaggaggagucagag

SEQ ID NO: 11818 - RNA, 23 nt, Artificial Sequence
  Synthetic
gaggggcugaggaggagucagag

SEQ ID NO: 11819 - RNA, 24 nt, Artificial Sequence
  Synthetic
ggaggggcugaggaggagucagag

SEQ ID NO: 11820 - RNA, 18 nt, Artificial Sequence
  Synthetic
gcccugcagagaagagag

SEQ ID NO: 11821 - RNA, 19 nt, Artificial Sequence
  Synthetic
ggcccugcagagaagagag

SEQ ID NO: 11822 - RNA, 20 nt, Artificial Sequence
  Synthetic
aggcccugcagagaagagag

SEQ ID NO: 11823 - RNA, 21 nt, Artificial Sequence
  Synthetic
caggcccugcagagaagagag

SEQ ID NO: 11824 - RNA, 22 nt, Artificial Sequence
  Synthetic
ucaggcccugcagagaagagag

SEQ ID NO: 11825 - RNA, 23 nt, Artificial Sequence
  Synthetic
cucaggcccugcagagaagagag

SEQ ID NO: 11826 - RNA, 24 nt, Artificial Sequence
  Synthetic
ccucaggcccugcagagaagagag

SEQ ID NO: 11827 - RNA, 18 nt, Artificial Sequence
  Synthetic
uggugagcaaggagagag

SEQ ID NO: 11828 - RNA, 19 nt, Artificial Sequence
  Synthetic
guggugagcaaggagagag

SEQ ID NO: 11829 - RNA, 21 nt, Artificial Sequence
  Synthetic
aaguggugagcaaggagagag

SEQ ID NO: 11830 - RNA, 22 nt, Artificial Sequence
  Synthetic
caaguggugagcaaggagagag

SEQ ID NO: 11831 - RNA, 23 nt, Artificial Sequence
  Synthetic
ccaaguggugagcaaggagagag

SEQ ID NO: 11832 - RNA, 24 nt, Artificial Sequence
  Synthetic
gccaaguggugagcaaggagagag

SEQ ID NO: 11833 - RNA, 18 nt, Artificial Sequence
  Synthetic
aagagggagacaauagag

SEQ ID NO: 11834 - RNA, 19 nt, Artificial Sequence
  Synthetic
aaagagggagacaauagag

SEQ ID NO: 11835 - RNA, 21 nt, Artificial Sequence
  Synthetic
agaaagagggagacaauagag

SEQ ID NO: 11836 - RNA, 22 nt, Artificial Sequence
  Synthetic
cagaaagagggagacaauagag

SEQ ID NO: 11837 - RNA, 23 nt, Artificial Sequence
  Synthetic
gcagaaagagggagacaauagag

SEQ ID NO: 11838 - RNA, 24 nt, Artificial Sequence
  Synthetic
ggcagaaagagggagacaauagag

SEQ ID NO: 11839 - RNA, 18 nt, Artificial Sequence
  Synthetic
ggagggcaacacaaggag

SEQ ID NO: 11840 - RNA, 19 nt, Artificial Sequence
  Synthetic
aggagggcaacacaaggag

SEQ ID NO: 11841 - RNA, 20 nt, Artificial Sequence
  Synthetic
uaggagggcaacacaaggag

SEQ ID NO: 11842 - RNA, 21 nt, Artificial Sequence
  Synthetic
cuaggagggcaacacaaggag

SEQ ID NO: 11843 - RNA, 22 nt, Artificial Sequence
  Synthetic
gcuaggagggcaacacaaggag

SEQ ID NO: 11844 - RNA, 23 nt, Artificial Sequence
  Synthetic
agcuaggagggcaacacaaggag

SEQ ID NO: 11845 - RNA, 24 nt, Artificial Sequence
  Synthetic
cagcuaggagggcaacacaaggag

SEQ ID NO: 11846 - RNA, 18 nt, Artificial Sequence
  Synthetic
gacaggcccugggaggag

SEQ ID NO: 11847 - RNA, 19 nt, Artificial Sequence
  Synthetic
agacaggcccugggaggag

SEQ ID NO: 11848 - RNA, 20 nt, Artificial Sequence
  Synthetic
uagacaggcccugggaggag

SEQ ID NO: 11849 - RNA, 21 nt, Artificial Sequence
  Synthetic
cuagacaggcccugggaggag

SEQ ID NO: 11850 - RNA, 22 nt, Artificial Sequence
  Synthetic
ccuagacaggcccugggaggag

SEQ ID NO: 11851 - RNA, 23 nt, Artificial Sequence
  Synthetic
gccuagacaggcccugggaggag

SEQ ID NO: 11852 - RNA, 24 nt, Artificial Sequence
  Synthetic
cgccuagacaggcccugggaggag

SEQ ID NO: 11853 - RNA, 18 nt, Artificial Sequence
  Synthetic
uagaaaacaaaauaggag

SEQ ID NO: 11854 - RNA, 19 nt, Artificial Sequence
  Synthetic
uuagaaaacaaaauaggag

SEQ ID NO: 11855 - RNA, 20 nt, Artificial Sequence
  Synthetic
guuagaaaacaaaauaggag

SEQ ID NO: 11856 - RNA, 21 nt, Artificial Sequence
  Synthetic
gguuagaaaacaaaauaggag

SEQ ID NO: 11857 - RNA, 22 nt, Artificial Sequence
  Synthetic
agguuagaaaacaaaauaggag

SEQ ID NO: 11858 - RNA, 23 nt, Artificial Sequence
  Synthetic
gagguuagaaaacaaaauaggag

SEQ ID NO: 11859 - RNA, 24 nt, Artificial Sequence
  Synthetic
ugagguuagaaaacaaaauaggag

SEQ ID NO: 11860 - RNA, 18 nt, Artificial Sequence
  Synthetic
gggccaaaagugccggag

SEQ ID NO: 11861 - RNA, 19 nt, Artificial Sequence
  Synthetic
ggggccaaaagugccggag

SEQ ID NO: 11862 - RNA, 20 nt, Artificial Sequence
  Synthetic
uggggccaaaagugccggag

SEQ ID NO: 11863 - RNA, 21 nt, Artificial Sequence
  Synthetic
uuggggccaaaagugccggag

SEQ ID NO: 11864 - RNA, 22 nt, Artificial Sequence
  Synthetic
guuggggccaaaagugccggag

SEQ ID NO: 11865 - RNA, 23 nt, Artificial Sequence
  Synthetic
aguuggggccaaaagugccggag

SEQ ID NO: 11866 - RNA, 24 nt, Artificial Sequence
  Synthetic
gaguuggggccaaaagugccggag

SEQ ID NO: 11867 - RNA, 18 nt, Artificial Sequence
  Synthetic
ccagcagaccugcgggag

SEQ ID NO: 11868 - RNA, 19 nt, Artificial Sequence
  Synthetic
gccagcagaccugcgggag

SEQ ID NO: 11869 - RNA, 20 nt, Artificial Sequence
  Synthetic
agccagcagaccugcgggag

SEQ ID NO: 11870 - RNA, 21 nt, Artificial Sequence
  Synthetic
gagccagcagaccugcgggag

SEQ ID NO: 11871 - RNA, 22 nt, Artificial Sequence
  Synthetic
ggagccagcagaccugcgggag

SEQ ID NO: 11872 - RNA, 23 nt, Artificial Sequence
  Synthetic
uggagccagcagaccugcgggag

SEQ ID NO: 11873 - RNA, 24 nt, Artificial Sequence
  Synthetic
cuggagccagcagaccugcgggag

SEQ ID NO: 11874 - RNA, 18 nt, Artificial Sequence
  Synthetic
cuagacaggcccugggag

SEQ ID NO: 11875 - RNA, 19 nt, Artificial Sequence
  Synthetic
ccuagacaggcccugggag

SEQ ID NO: 11876 - RNA, 20 nt, Artificial Sequence
  Synthetic
gccuagacaggcccugggag

SEQ ID NO: 11877 - RNA, 21 nt, Artificial Sequence
  Synthetic
cgccuagacaggcccugggag

SEQ ID NO: 11878 - RNA, 22 nt, Artificial Sequence
  Synthetic
acgccuagacaggcccugggag

SEQ ID NO: 11879 - RNA, 23 nt, Artificial Sequence
  Synthetic
cacgccuagacaggcccugggag

SEQ ID NO: 11880 - RNA, 24 nt, Artificial Sequence
  Synthetic
acacgccuagacaggcccugggag

SEQ ID NO: 11881 - RNA, 18 nt, Artificial Sequence
  Synthetic
agagagauagggauggag

SEQ ID NO: 11882 - RNA, 19 nt, Artificial Sequence
  Synthetic
cagagagauagggauggag

SEQ ID NO: 11883 - RNA, 20 nt, Artificial Sequence
  Synthetic
acagagagauagggauggag

SEQ ID NO: 11884 - RNA, 21 nt, Artificial Sequence
  Synthetic
gacagagagauagggauggag

SEQ ID NO: 11885 - RNA, 22 nt, Artificial Sequence
  Synthetic
ggacagagagauagggauggag

SEQ ID NO: 11886 - RNA, 23 nt, Artificial Sequence
  Synthetic
aggacagagagauagggauggag

SEQ ID NO: 11887 - RNA, 24 nt, Artificial Sequence
  Synthetic
aaggacagagagauagggauggag

SEQ ID NO: 11888 - RNA, 18 nt, Artificial Sequence
  Synthetic
gcggggggaggggcugag

SEQ ID NO: 11889 - RNA, 19 nt, Artificial Sequence
  Synthetic
ggcggggggaggggcugag

SEQ ID NO: 11890 - RNA, 20 nt, Artificial Sequence
  Synthetic
gggcggggggaggggcugag

SEQ ID NO: 11891 - RNA, 21 nt, Artificial Sequence
  Synthetic
agggcggggggaggggcugag

SEQ ID NO: 11892 - RNA, 22 nt, Artificial Sequence
  Synthetic
cagggcggggggaggggcugag

SEQ ID NO: 11893 - RNA, 23 nt, Artificial Sequence
  Synthetic
gcagggcggggggaggggcugag

SEQ ID NO: 11894 - RNA, 24 nt, Artificial Sequence
  Synthetic
agcagggcggggggaggggcugag

SEQ ID NO: 11895 - RNA, 18 nt, Artificial Sequence
  Synthetic
ggaggggcacugagugag

SEQ ID NO: 11896 - RNA, 19 nt, Artificial Sequence
  Synthetic
aggaggggcacugagugag

SEQ ID NO: 11897 - RNA, 20 nt, Artificial Sequence
  Synthetic
gaggaggggcacugagugag

SEQ ID NO: 11898 - RNA, 21 nt, Artificial Sequence
  Synthetic
ggaggaggggcacugagugag

SEQ ID NO: 11899 - RNA, 22 nt, Artificial Sequence
  Synthetic
uggaggaggggcacugagugag

SEQ ID NO: 11900 - RNA, 23 nt, Artificial Sequence
  Synthetic
auggaggaggggcacugagugag

SEQ ID NO: 11901 - RNA, 24 nt, Artificial Sequence
  Synthetic
gauggaggaggggcacugagugag

SEQ ID NO: 11902 - RNA, 18 nt, Artificial Sequence
  Synthetic
aucucaauuaaaggugag

SEQ ID NO: 11903 - RNA, 19 nt, Artificial Sequence
  Synthetic
caucucaauuaaaggugag

SEQ ID NO: 11904 - RNA, 20 nt, Artificial Sequence
  Synthetic
gcaucucaauuaaaggugag

SEQ ID NO: 11905 - RNA, 21 nt, Artificial Sequence
  Synthetic
agcaucucaauuaaaggugag

SEQ ID NO: 11906 - RNA, 22 nt, Artificial Sequence
  Synthetic
uagcaucucaauuaaaggugag

SEQ ID NO: 11907 - RNA, 23 nt, Artificial Sequence
  Synthetic
uuagcaucucaauuaaaggugag

SEQ ID NO: 11908 - RNA, 24 nt, Artificial Sequence
  Synthetic
auuagcaucucaauuaaaggugag

SEQ ID NO: 11909 - RNA, 18 nt, Artificial Sequence
  Synthetic
aguggugggggcaaauag

SEQ ID NO: 11910 - RNA, 19 nt, Artificial Sequence
  Synthetic
caguggugggggcaaauag

SEQ ID NO: 11911 - RNA, 20 nt, Artificial Sequence
  Synthetic
gcaguggugggggcaaauag

SEQ ID NO: 11912 - RNA, 21 nt, Artificial Sequence
  Synthetic
ggcaguggugggggcaaauag

SEQ ID NO: 11913 - RNA, 22 nt, Artificial Sequence
  Synthetic
gggcaguggugggggcaaauag

SEQ ID NO: 11914 - RNA, 23 nt, Artificial Sequence
  Synthetic
ggggcaguggugggggcaaauag

SEQ ID NO: 11915 - RNA, 24 nt, Artificial Sequence
  Synthetic
gggggcaguggugggggcaaauag

SEQ ID NO: 11916 - RNA, 18 nt, Artificial Sequence
  Synthetic
uccugagcccacagcuag

SEQ ID NO: 11917 - RNA, 19 nt, Artificial Sequence
  Synthetic
auccugagcccacagcuag

SEQ ID NO: 11918 - RNA, 20 nt, Artificial Sequence
  Synthetic
gauccugagcccacagcuag

SEQ ID NO: 11919 - RNA, 21 nt, Artificial Sequence
  Synthetic
ggauccugagcccacagcuag

SEQ ID NO: 11920 - RNA, 22 nt, Artificial Sequence
  Synthetic
aggauccugagcccacagcuag

SEQ ID NO: 11921 - RNA, 23 nt, Artificial Sequence
  Synthetic
aaggauccugagcccacagcuag

SEQ ID NO: 11922 - RNA, 24 nt, Artificial Sequence
  Synthetic
gaaggauccugagcccacagcuag

SEQ ID NO: 11923 - RNA, 18 nt, Artificial Sequence
  Synthetic
auaagagccaagggcuag

SEQ ID NO: 11924 - RNA, 19 nt, Artificial Sequence
  Synthetic
cauaagagccaagggcuag

SEQ ID NO: 11925 - RNA, 21 nt, Artificial Sequence
  Synthetic
gacauaagagccaagggcuag

SEQ ID NO: 11926 - RNA, 22 nt, Artificial Sequence
  Synthetic
agacauaagagccaagggcuag

SEQ ID NO: 11927 - RNA, 23 nt, Artificial Sequence
  Synthetic
aagacauaagagccaagggcuag

SEQ ID NO: 11928 - RNA, 24 nt, Artificial Sequence
  Synthetic
uaagacauaagagccaagggcuag

SEQ ID NO: 11929 - RNA, 18 nt, Artificial Sequence
  Synthetic
ggugaagcugggggcuag

SEQ ID NO: 11930 - RNA, 19 nt, Artificial Sequence
  Synthetic
aggugaagcugggggcuag

SEQ ID NO: 11931 - RNA, 20 nt, Artificial Sequence
  Synthetic
caggugaagcugggggcuag

SEQ ID NO: 11932 - RNA, 21 nt, Artificial Sequence
  Synthetic
ccaggugaagcugggggcuag

SEQ ID NO: 11933 - RNA, 22 nt, Artificial Sequence
  Synthetic
cccaggugaagcugggggcuag

SEQ ID NO: 11934 - RNA, 23 nt, Artificial Sequence
  Synthetic
gcccaggugaagcugggggcuag

SEQ ID NO: 11935 - RNA, 24 nt, Artificial Sequence
  Synthetic
ggcccaggugaagcugggggcuag

SEQ ID NO: 11936 - RNA, 18 nt, Artificial Sequence
  Synthetic
ggcagcgcgagggccacg

SEQ ID NO: 11937 - RNA, 19 nt, Artificial Sequence
  Synthetic
aggcagcgcgagggccacg

SEQ ID NO: 11938 - RNA, 20 nt, Artificial Sequence
  Synthetic
gaggcagcgcgagggccacg

SEQ ID NO: 11939 - RNA, 21 nt, Artificial Sequence
  Synthetic
agaggcagcgcgagggccacg

SEQ ID NO: 11940 - RNA, 22 nt, Artificial Sequence
  Synthetic
cagaggcagcgcgagggccacg

SEQ ID NO: 11941 - RNA, 23 nt, Artificial Sequence
  Synthetic
ccagaggcagcgcgagggccacg

SEQ ID NO: 11942 - RNA, 24 nt, Artificial Sequence
  Synthetic
accagaggcagcgcgagggccacg

SEQ ID NO: 11943 - RNA, 18 nt, Artificial Sequence
  Synthetic
gagcauugauacacaccg

SEQ ID NO: 11944 - RNA, 19 nt, Artificial Sequence
  Synthetic
ugagcauugauacacaccg

SEQ ID NO: 11945 - RNA, 21 nt, Artificial Sequence
  Synthetic
ccugagcauugauacacaccg

SEQ ID NO: 11946 - RNA, 22 nt, Artificial Sequence
  Synthetic
gccugagcauugauacacaccg

SEQ ID NO: 11947 - RNA, 23 nt, Artificial Sequence
  Synthetic
agccugagcauugauacacaccg

SEQ ID NO: 11948 - RNA, 24 nt, Artificial Sequence
  Synthetic
cagccugagcauugauacacaccg

SEQ ID NO: 11949 - RNA, 18 nt, Artificial Sequence
  Synthetic
agagccgggaguuuuccg

SEQ ID NO: 11950 - RNA, 19 nt, Artificial Sequence
  Synthetic
cagagccgggaguuuuccg

SEQ ID NO: 11951 - RNA, 20 nt, Artificial Sequence
  Synthetic
ucagagccgggaguuuuccg

SEQ ID NO: 11952 - RNA, 21 nt, Artificial Sequence
  Synthetic
gucagagccgggaguuuuccg

SEQ ID NO: 11953 - RNA, 22 nt, Artificial Sequence
  Synthetic
agucagagccgggaguuuuccg

SEQ ID NO: 11954 - RNA, 23 nt, Artificial Sequence
  Synthetic
gagucagagccgggaguuuuccg

SEQ ID NO: 11955 - RNA, 24 nt, Artificial Sequence
  Synthetic
ggagucagagccgggaguuuuccg

SEQ ID NO: 11956 - RNA, 18 nt, Artificial Sequence
  Synthetic
caauagagagggacagcg

SEQ ID NO: 11957 - RNA, 19 nt, Artificial Sequence
  Synthetic
acaauagagagggacagcg

SEQ ID NO: 11958 - RNA, 20 nt, Artificial Sequence
  Synthetic
gacaauagagagggacagcg

SEQ ID NO: 11959 - RNA, 21 nt, Artificial Sequence
  Synthetic
agacaauagagagggacagcg

SEQ ID NO: 11960 - RNA, 22 nt, Artificial Sequence
  Synthetic
gagacaauagagagggacagcg

SEQ ID NO: 11961 - RNA, 23 nt, Artificial Sequence
  Synthetic
ggagacaauagagagggacagcg

SEQ ID NO: 11962 - RNA, 24 nt, Artificial Sequence
  Synthetic
gggagacaauagagagggacagcg

SEQ ID NO: 11963 - RNA, 18 nt, Artificial Sequence
  Synthetic
gggaggauguggccagcg

SEQ ID NO: 11964 - RNA, 19 nt, Artificial Sequence
  Synthetic
agggaggauguggccagcg

SEQ ID NO: 11965 - RNA, 20 nt, Artificial Sequence
  Synthetic
cagggaggauguggccagcg

SEQ ID NO: 11966 - RNA, 21 nt, Artificial Sequence
  Synthetic
gcagggaggauguggccagcg

SEQ ID NO: 11967 - RNA, 22 nt, Artificial Sequence
  Synthetic
ugcagggaggauguggccagcg

SEQ ID NO: 11968 - RNA, 23 nt, Artificial Sequence
  Synthetic
gugcagggaggauguggccagcg

SEQ ID NO: 11969 - RNA, 24 nt, Artificial Sequence
  Synthetic
ggugcagggaggauguggccagcg

SEQ ID NO: 11970 - RNA, 18 nt, Artificial Sequence
  Synthetic
uuaaaggugagcagggcg

SEQ ID NO: 11971 - RNA, 19 nt, Artificial Sequence
  Synthetic
auuaaaggugagcagggcg

SEQ ID NO: 11972 - RNA, 21 nt, Artificial Sequence
  Synthetic
caauuaaaggugagcagggcg

SEQ ID NO: 11973 - RNA, 22 nt, Artificial Sequence
  Synthetic
ucaauuaaaggugagcagggcg

SEQ ID NO: 11974 - RNA, 23 nt, Artificial Sequence
  Synthetic
cucaauuaaaggugagcagggcg

SEQ ID NO: 11975 - RNA, 24 nt, Artificial Sequence
  Synthetic
ucucaauuaaaggugagcagggcg

SEQ ID NO: 11976 - RNA, 18 nt, Artificial Sequence
  Synthetic
uggccagcgcuggaaagg

SEQ ID NO: 11977 - RNA, 19 nt, Artificial Sequence
  Synthetic
guggccagcgcuggaaagg

SEQ ID NO: 11978 - RNA, 20 nt, Artificial Sequence
  Synthetic
uguggccagcgcuggaaagg

SEQ ID NO: 11979 - RNA, 21 nt, Artificial Sequence
  Synthetic
auguggccagcgcuggaaagg

SEQ ID NO: 11980 - RNA, 22 nt, Artificial Sequence
  Synthetic
gauguggccagcgcuggaaagg

SEQ ID NO: 11981 - RNA, 23 nt, Artificial Sequence
  Synthetic
ggauguggccagcgcuggaaagg

SEQ ID NO: 11982 - RNA, 24 nt, Artificial Sequence
  Synthetic
aggauguggccagcgcuggaaagg

SEQ ID NO: 11983 - RNA, 18 nt, Artificial Sequence
  Synthetic
ccaggaaggagagcaagg

SEQ ID NO: 11984 - RNA, 19 nt, Artificial Sequence
  Synthetic
uccaggaaggagagcaagg

SEQ ID NO: 11985 - RNA, 21 nt, Artificial Sequence
  Synthetic
ucuccaggaaggagagcaagg

SEQ ID NO: 11986 - RNA, 22 nt, Artificial Sequence
  Synthetic
gucuccaggaaggagagcaagg

SEQ ID NO: 11987 - RNA, 23 nt, Artificial Sequence
  Synthetic
ugucuccaggaaggagagcaagg

SEQ ID NO: 11988 - RNA, 24 nt, Artificial Sequence
  Synthetic
cugucuccaggaaggagagcaagg

SEQ ID NO: 11989 - RNA, 18 nt, Artificial Sequence
  Synthetic
ccgggaguuuuccgaagg

SEQ ID NO: 11990 - RNA, 19 nt, Artificial Sequence
  Synthetic
gccgggaguuuuccgaagg

SEQ ID NO: 11991 - RNA, 20 nt, Artificial Sequence
  Synthetic
agccgggaguuuuccgaagg

SEQ ID NO: 11992 - RNA, 21 nt, Artificial Sequence
  Synthetic
gagccgggaguuuuccgaagg

SEQ ID NO: 11993 - RNA, 22 nt, Artificial Sequence
  Synthetic
agagccgggaguuuuccgaagg

SEQ ID NO: 11994 - RNA, 23 nt, Artificial Sequence
  Synthetic
cagagccgggaguuuuccgaagg

SEQ ID NO: 11995 - RNA, 24 nt, Artificial Sequence
  Synthetic
ucagagccgggaguuuuccgaagg

SEQ ID NO: 11996 - RNA, 18 nt, Artificial Sequence
  Synthetic
acagacccggagcccagg

SEQ ID NO: 11997 - RNA, 19 nt, Artificial Sequence
  Synthetic
cacagacccggagcccagg

SEQ ID NO: 11998 - RNA, 20 nt, Artificial Sequence
  Synthetic
acacagacccggagcccagg

SEQ ID NO: 11999 - RNA, 21 nt, Artificial Sequence
  Synthetic
gacacagacccggagcccagg

SEQ ID NO: 12000 - RNA, 22 nt, Artificial Sequence
  Synthetic
ggacacagacccggagcccagg

SEQ ID NO: 12001 - RNA, 23 nt, Artificial Sequence
  Synthetic
uggacacagacccggagcccagg

SEQ ID NO: 12002 - RNA, 24 nt, Artificial Sequence
  Synthetic
guggacacagacccggagcccagg

SEQ ID NO: 12003 - RNA, 18 nt, Artificial Sequence
  Synthetic
gagaaggggccagccagg

SEQ ID NO: 12004 - RNA, 19 nt, Artificial Sequence
  Synthetic
ggagaaggggccagccagg

SEQ ID NO: 12005 - RNA, 20 nt, Artificial Sequence
  Synthetic
aggagaaggggccagccagg

SEQ ID NO: 12006 - RNA, 21 nt, Artificial Sequence
  Synthetic
aaggagaaggggccagccagg

SEQ ID NO: 12007 - RNA, 22 nt, Artificial Sequence
  Synthetic
caaggagaaggggccagccagg

SEQ ID NO: 12008 - RNA, 23 nt, Artificial Sequence
  Synthetic
acaaggagaaggggccagccagg

SEQ ID NO: 12009 - RNA, 24 nt, Artificial Sequence
  Synthetic
cacaaggagaaggggccagccagg

SEQ ID NO: 12010 - RNA, 18 nt, Artificial Sequence
  Synthetic
agggagucugucuccagg

SEQ ID NO: 12011 - RNA, 19 nt, Artificial Sequence
  Synthetic
aagggagucugucuccagg

SEQ ID NO: 12012 - RNA, 20 nt, Artificial Sequence
  Synthetic
aaagggagucugucuccagg

SEQ ID NO: 12013 - RNA, 21 nt, Artificial Sequence
  Synthetic
caaagggagucugucuccagg

SEQ ID NO: 12014 - RNA, 22 nt, Artificial Sequence
  Synthetic
ccaaagggagucugucuccagg

SEQ ID NO: 12015 - RNA, 23 nt, Artificial Sequence
  Synthetic
accaaagggagucugucuccagg

SEQ ID NO: 12016 - RNA, 24 nt, Artificial Sequence
  Synthetic
caccaaagggagucugucuccagg

SEQ ID NO: 12017 - RNA, 18 nt, Artificial Sequence
  Synthetic
caauuaaaggugagcagg

SEQ ID NO: 12018 - RNA, 19 nt, Artificial Sequence
  Synthetic
ucaauuaaaggugagcagg

SEQ ID NO: 12019 - RNA, 20 nt, Artificial Sequence
  Synthetic
cucaauuaaaggugagcagg

SEQ ID NO: 12020 - RNA, 21 nt, Artificial Sequence
  Synthetic
ucucaauuaaaggugagcagg

SEQ ID NO: 12021 - RNA, 22 nt, Artificial Sequence
  Synthetic
aucucaauuaaaggugagcagg

SEQ ID NO: 12022 - RNA, 23 nt, Artificial Sequence
  Synthetic
caucucaauuaaaggugagcagg

SEQ ID NO: 12023 - RNA, 24 nt, Artificial Sequence
  Synthetic
gcaucucaauuaaaggugagcagg

SEQ ID NO: 12024 - RNA, 18 nt, Artificial Sequence
  Synthetic
ugagugaguagaggcagg

SEQ ID NO: 12025 - RNA, 19 nt, Artificial Sequence
  Synthetic
cugagugaguagaggcagg

SEQ ID NO: 12026 - RNA, 21 nt, Artificial Sequence
  Synthetic
cacugagugaguagaggcagg

SEQ ID NO: 12027 - RNA, 22 nt, Artificial Sequence
  Synthetic
gcacugagugaguagaggcagg

SEQ ID NO: 12028 - RNA, 23 nt, Artificial Sequence
  Synthetic
ggcacugagugaguagaggcagg

SEQ ID NO: 12029 - RNA, 24 nt, Artificial Sequence
  Synthetic
gggcacugagugaguagaggcagg

SEQ ID NO: 12030 - RNA, 18 nt, Artificial Sequence
  Synthetic
gcgcuggaaaggaagagg

SEQ ID NO: 12031 - RNA, 19 nt, Artificial Sequence
  Synthetic
agcgcuggaaaggaagagg

SEQ ID NO: 12032 - RNA, 20 nt, Artificial Sequence
  Synthetic
cagcgcuggaaaggaagagg

SEQ ID NO: 12033 - RNA, 21 nt, Artificial Sequence
  Synthetic
ccagcgcuggaaaggaagagg

SEQ ID NO: 12034 - RNA, 22 nt, Artificial Sequence
  Synthetic
gccagcgcuggaaaggaagagg

SEQ ID NO: 12035 - RNA, 23 nt, Artificial Sequence
  Synthetic
ggccagcgcuggaaaggaagagg

SEQ ID NO: 12036 - RNA, 24 nt, Artificial Sequence
  Synthetic
uggccagcgcuggaaaggaagagg

SEQ ID NO: 12037 - RNA, 18 nt, Artificial Sequence
  Synthetic
ccggagcccaggaagagg

SEQ ID NO: 12038 - RNA, 19 nt, Artificial Sequence
  Synthetic
cccggagcccaggaagagg

SEQ ID NO: 12039 - RNA, 20 nt, Artificial Sequence
  Synthetic
acccggagcccaggaagagg

SEQ ID NO: 12040 - RNA, 21 nt, Artificial Sequence
  Synthetic
gacccggagcccaggaagagg

SEQ ID NO: 12041 - RNA, 22 nt, Artificial Sequence
  Synthetic
agacccggagcccaggaagagg

SEQ ID NO: 12042 - RNA, 23 nt, Artificial Sequence
  Synthetic
cagacccggagcccaggaagagg

SEQ ID NO: 12043 - RNA, 24 nt, Artificial Sequence
  Synthetic
acagacccggagcccaggaagagg

SEQ ID NO: 12044 - RNA, 18 nt, Artificial Sequence
  Synthetic
cgcagacaggcaaggagg

SEQ ID NO: 12045 - RNA, 19 nt, Artificial Sequence
  Synthetic
acgcagacaggcaaggagg

SEQ ID NO: 12046 - RNA, 20 nt, Artificial Sequence
  Synthetic
gacgcagacaggcaaggagg

SEQ ID NO: 12047 - RNA, 21 nt, Artificial Sequence
  Synthetic
agacgcagacaggcaaggagg

SEQ ID NO: 12048 - RNA, 22 nt, Artificial Sequence
  Synthetic
uagacgcagacaggcaaggagg

SEQ ID NO: 12049 - RNA, 23 nt, Artificial Sequence
  Synthetic
uuagacgcagacaggcaaggagg

SEQ ID NO: 12050 - RNA, 24 nt, Artificial Sequence
  Synthetic
uuuagacgcagacaggcaaggagg

SEQ ID NO: 12051 - RNA, 18 nt, Artificial Sequence
  Synthetic
uagacaggcccugggagg

SEQ ID NO: 12052 - RNA, 19 nt, Artificial Sequence
  Synthetic
cuagacaggcccugggagg

SEQ ID NO: 12053 - RNA, 21 nt, Artificial Sequence
  Synthetic
gccuagacaggcccugggagg

SEQ ID NO: 12054 - RNA, 22 nt, Artificial Sequence
  Synthetic
cgccuagacaggcccugggagg

SEQ ID NO: 12055 - RNA, 23 nt, Artificial Sequence
  Synthetic
acgccuagacaggcccugggagg

SEQ ID NO: 12056 - RNA, 24 nt, Artificial Sequence
  Synthetic
cacgccuagacaggcccugggagg

SEQ ID NO: 12057 - RNA, 18 nt, Artificial Sequence
  Synthetic
gagagauagggauggagg

SEQ ID NO: 12058 - RNA, 19 nt, Artificial Sequence
  Synthetic
agagagauagggauggagg

SEQ ID NO: 12059 - RNA, 21 nt, Artificial Sequence
  Synthetic
acagagagauagggauggagg

SEQ ID NO: 12060 - RNA, 22 nt, Artificial Sequence
  Synthetic
gacagagagauagggauggagg

SEQ ID NO: 12061 - RNA, 23 nt, Artificial Sequence
  Synthetic
ggacagagagauagggauggagg

SEQ ID NO: 12062 - RNA, 24 nt, Artificial Sequence
  Synthetic
aggacagagagauagggauggagg

SEQ ID NO: 12063 - RNA, 18 nt, Artificial Sequence
  Synthetic
gugaagcugggggcuagg

SEQ ID NO: 12064 - RNA, 19 nt, Artificial Sequence
  Synthetic
ggugaagcugggggcuagg

SEQ ID NO: 12065 - RNA, 21 nt, Artificial Sequence
  Synthetic
caggugaagcugggggcuagg

SEQ ID NO: 12066 - RNA, 22 nt, Artificial Sequence
  Synthetic
ccaggugaagcugggggcuagg

SEQ ID NO: 12067 - RNA, 23 nt, Artificial Sequence
  Synthetic
cccaggugaagcugggggcuagg

SEQ ID NO: 12068 - RNA, 24 nt, Artificial Sequence
  Synthetic
gcccaggugaagcugggggcuagg

SEQ ID NO: 12069 - RNA, 18 nt, Artificial Sequence
  Synthetic
gccuggguggggaaccgg

SEQ ID NO: 12070 - RNA, 19 nt, Artificial Sequence
  Synthetic
ggccuggguggggaaccgg

SEQ ID NO: 12071 - RNA, 20 nt, Artificial Sequence
  Synthetic
gggccuggguggggaaccgg

SEQ ID NO: 12072 - RNA, 21 nt, Artificial Sequence
  Synthetic
agggccuggguggggaaccgg

SEQ ID NO: 12073 - RNA, 22 nt, Artificial Sequence
  Synthetic
gagggccuggguggggaaccgg

SEQ ID NO: 12074 - RNA, 23 nt, Artificial Sequence
  Synthetic
agagggccuggguggggaaccgg

SEQ ID NO: 12075 - RNA, 24 nt, Artificial Sequence
  Synthetic
gagagggccuggguggggaaccgg

SEQ ID NO: 12076 - RNA, 18 nt, Artificial Sequence
  Synthetic
agcauugauacacaccgg

SEQ ID NO: 12077 - RNA, 19 nt, Artificial Sequence
  Synthetic
gagcauugauacacaccgg

SEQ ID NO: 12078 - RNA, 21 nt, Artificial Sequence
  Synthetic
cugagcauugauacacaccgg

SEQ ID NO: 12079 - RNA, 22 nt, Artificial Sequence
  Synthetic
ccugagcauugauacacaccgg

SEQ ID NO: 12080 - RNA, 23 nt, Artificial Sequence
  Synthetic
gccugagcauugauacacaccgg

SEQ ID NO: 12081 - RNA, 24 nt, Artificial Sequence
  Synthetic
agccugagcauugauacacaccgg

SEQ ID NO: 12082 - RNA, 18 nt, Artificial Sequence
  Synthetic
aaccuuguccagacccgg

SEQ ID NO: 12083 - RNA, 19 nt, Artificial Sequence
  Synthetic
caaccuuguccagacccgg

SEQ ID NO: 12084 - RNA, 20 nt, Artificial Sequence
  Synthetic
ccaaccuuguccagacccgg

SEQ ID NO: 12085 - RNA, 21 nt, Artificial Sequence
  Synthetic
uccaaccuuguccagacccgg

SEQ ID NO: 12086 - RNA, 22 nt, Artificial Sequence
  Synthetic
cuccaaccuuguccagacccgg

SEQ ID NO: 12087 - RNA, 23 nt, Artificial Sequence
  Synthetic
ccuccaaccuuguccagacccgg

SEQ ID NO: 12088 - RNA, 24 nt, Artificial Sequence
  Synthetic
cccuccaaccuuguccagacccgg

SEQ ID NO: 12089 - RNA, 18 nt, Artificial Sequence
  Synthetic
cccaggcccugcacgcgg

SEQ ID NO: 12090 - RNA, 19 nt, Artificial Sequence
  Synthetic
acccaggcccugcacgcgg

SEQ ID NO: 12091 - RNA, 20 nt, Artificial Sequence
  Synthetic
aacccaggcccugcacgcgg

SEQ ID NO: 12092 - RNA, 21 nt, Artificial Sequence
  Synthetic
caacccaggcccugcacgcgg

SEQ ID NO: 12093 - RNA, 22 nt, Artificial Sequence
  Synthetic
acaacccaggcccugcacgcgg

SEQ ID NO: 12094 - RNA, 23 nt, Artificial Sequence
  Synthetic
cacaacccaggcccugcacgcgg

SEQ ID NO: 12095 - RNA, 24 nt, Artificial Sequence
  Synthetic
acacaacccaggcccugcacgcgg

SEQ ID NO: 12096 - RNA, 18 nt, Artificial Sequence
  Synthetic
uaaaggugagcagggcgg

SEQ ID NO: 12097 - RNA, 19 nt, Artificial Sequence
  Synthetic
uuaaaggugagcagggcgg

SEQ ID NO: 12098 - RNA, 21 nt, Artificial Sequence
  Synthetic
aauuaaaggugagcagggcgg

SEQ ID NO: 12099 - RNA, 22 nt, Artificial Sequence
  Synthetic
caauuaaaggugagcagggcgg

SEQ ID NO: 12100 - RNA, 23 nt, Artificial Sequence
  Synthetic
ucaauuaaaggugagcagggcgg

SEQ ID NO: 12101 - RNA, 24 nt, Artificial Sequence
  Synthetic
cucaauuaaaggugagcagggcgg

SEQ ID NO: 12102 - RNA, 18 nt, Artificial Sequence
  Synthetic
cccacucccagguugcgg

SEQ ID NO: 12103 - RNA, 19 nt, Artificial Sequence
  Synthetic
ucccacucccagguugcgg

SEQ ID NO: 12104 - RNA, 20 nt, Artificial Sequence
  Synthetic
uucccacucccagguugcgg

SEQ ID NO: 12105 - RNA, 21 nt, Artificial Sequence
  Synthetic
cuucccacucccagguugcgg

SEQ ID NO: 12106 - RNA, 22 nt, Artificial Sequence
  Synthetic
gcuucccacucccagguugcgg

SEQ ID NO: 12107 - RNA, 23 nt, Artificial Sequence
  Synthetic
agcuucccacucccagguugcgg

SEQ ID NO: 12108 - RNA, 24 nt, Artificial Sequence
  Synthetic
cagcuucccacucccagguugcgg

SEQ ID NO: 12109 - RNA, 18 nt, Artificial Sequence
  Synthetic
gggcuggaggagacucgg

SEQ ID NO: 12110 - RNA, 19 nt, Artificial Sequence
  Synthetic
agggcuggaggagacucgg

SEQ ID NO: 12111 - RNA, 20 nt, Artificial Sequence
  Synthetic
aagggcuggaggagacucgg

SEQ ID NO: 12112 - RNA, 21 nt, Artificial Sequence
  Synthetic
aaagggcuggaggagacucgg

SEQ ID NO: 12113 - RNA, 22 nt, Artificial Sequence
  Synthetic
aaaagggcuggaggagacucgg

SEQ ID NO: 12114 - RNA, 23 nt, Artificial Sequence
  Synthetic
aaaaagggcuggaggagacucgg

SEQ ID NO: 12115 - RNA, 24 nt, Artificial Sequence
  Synthetic
caaaaagggcuggaggagacucgg

SEQ ID NO: 12116 - RNA, 18 nt, Artificial Sequence
  Synthetic
aaucagacccaaaaaggg

SEQ ID NO: 12117 - RNA, 19 nt, Artificial Sequence
  Synthetic
gaaucagacccaaaaaggg

SEQ ID NO: 12118 - RNA, 20 nt, Artificial Sequence
  Synthetic
agaaucagacccaaaaaggg

SEQ ID NO: 12119 - RNA, 21 nt, Artificial Sequence
  Synthetic
gagaaucagacccaaaaaggg

SEQ ID NO: 12120 - RNA, 22 nt, Artificial Sequence
  Synthetic
agagaaucagacccaaaaaggg

SEQ ID NO: 12121 - RNA, 23 nt, Artificial Sequence
  Synthetic
cagagaaucagacccaaaaaggg

SEQ ID NO: 12122 - RNA, 24 nt, Artificial Sequence
  Synthetic
ucagagaaucagacccaaaaaggg

SEQ ID NO: 12123 - RNA, 18 nt, Artificial Sequence
  Synthetic
cccgcuggccggccaggg

SEQ ID NO: 12124 - RNA, 19 nt, Artificial Sequence
  Synthetic
gcccgcuggccggccaggg

SEQ ID NO: 12125 - RNA, 20 nt, Artificial Sequence
  Synthetic
cgcccgcuggccggccaggg

SEQ ID NO: 12126 - RNA, 21 nt, Artificial Sequence
  Synthetic
ccgcccgcuggccggccaggg

SEQ ID NO: 12127 - RNA, 22 nt, Artificial Sequence
  Synthetic
cccgcccgcuggccggccaggg

SEQ ID NO: 12128 - RNA, 23 nt, Artificial Sequence
  Synthetic
gcccgcccgcuggccggccaggg

SEQ ID NO: 12129 - RNA, 24 nt, Artificial Sequence
  Synthetic
agcccgcccgcuggccggccaggg

SEQ ID NO: 12130 - RNA, 18 nt, Artificial Sequence
  Synthetic
aauuaaaggugagcaggg

SEQ ID NO: 12131 - RNA, 19 nt, Artificial Sequence
  Synthetic
caauuaaaggugagcaggg

SEQ ID NO: 12132 - RNA, 21 nt, Artificial Sequence
  Synthetic
cucaauuaaaggugagcaggg

SEQ ID NO: 12133 - RNA, 22 nt, Artificial Sequence
  Synthetic
ucucaauuaaaggugagcaggg

SEQ ID NO: 12134 - RNA, 23 nt, Artificial Sequence
  Synthetic
aucucaauuaaaggugagcaggg

SEQ ID NO: 12135 - RNA, 24 nt, Artificial Sequence
  Synthetic
caucucaauuaaaggugagcaggg

SEQ ID NO: 12136 - RNA, 18 nt, Artificial Sequence
  Synthetic
accgggaggacaggaggg

SEQ ID NO: 12137 - RNA, 19 nt, Artificial Sequence
  Synthetic
aaccgggaggacaggaggg

SEQ ID NO: 12138 - RNA, 20 nt, Artificial Sequence
  Synthetic
gaaccgggaggacaggaggg

SEQ ID NO: 12139 - RNA, 21 nt, Artificial Sequence
  Synthetic
ggaaccgggaggacaggaggg

SEQ ID NO: 12140 - RNA, 22 nt, Artificial Sequence
  Synthetic
gggaaccgggaggacaggaggg

SEQ ID NO: 12141 - RNA, 23 nt, Artificial Sequence
  Synthetic
ggggaaccgggaggacaggaggg

SEQ ID NO: 12142 - RNA, 24 nt, Artificial Sequence
  Synthetic
uggggaaccgggaggacaggaggg

SEQ ID NO: 12143 - RNA, 18 nt, Artificial Sequence
  Synthetic
aaggacagagagauaggg

SEQ ID NO: 12144 - RNA, 19 nt, Artificial Sequence
  Synthetic
gaaggacagagagauaggg

SEQ ID NO: 12145 - RNA, 20 nt, Artificial Sequence
  Synthetic
cgaaggacagagagauaggg

SEQ ID NO: 12146 - RNA, 21 nt, Artificial Sequence
  Synthetic
gcgaaggacagagagauaggg

SEQ ID NO: 12147 - RNA, 22 nt, Artificial Sequence
  Synthetic
agcgaaggacagagagauaggg

SEQ ID NO: 12148 - RNA, 23 nt, Artificial Sequence
  Synthetic
cagcgaaggacagagagauaggg

SEQ ID NO: 12149 - RNA, 24 nt, Artificial Sequence
  Synthetic
acagcgaaggacagagagauaggg

SEQ ID NO: 12150 - RNA, 18 nt, Artificial Sequence
  Synthetic
accuuguccagacccggg

SEQ ID NO: 12151 - RNA, 19 nt, Artificial Sequence
  Synthetic
aaccuuguccagacccggg

SEQ ID NO: 12152 - RNA, 21 nt, Artificial Sequence
  Synthetic
ccaaccuuguccagacccggg

SEQ ID NO: 12153 - RNA, 22 nt, Artificial Sequence
  Synthetic
uccaaccuuguccagacccggg

SEQ ID NO: 12154 - RNA, 23 nt, Artificial Sequence
  Synthetic
cuccaaccuuguccagacccggg

SEQ ID NO: 12155 - RNA, 24 nt, Artificial Sequence
  Synthetic
ccuccaaccuuguccagacccggg

SEQ ID NO: 12156 - RNA, 18 nt, Artificial Sequence
  Synthetic
aaaggugagcagggcggg

SEQ ID NO: 12157 - RNA, 19 nt, Artificial Sequence
  Synthetic
uaaaggugagcagggcggg

SEQ ID NO: 12158 - RNA, 21 nt, Artificial Sequence
  Synthetic
auuaaaggugagcagggcggg

SEQ ID NO: 12159 - RNA, 22 nt, Artificial Sequence
  Synthetic
aauuaaaggugagcagggcggg

SEQ ID NO: 12160 - RNA, 23 nt, Artificial Sequence
  Synthetic
caauuaaaggugagcagggcggg

SEQ ID NO: 12161 - RNA, 24 nt, Artificial Sequence
  Synthetic
ucaauuaaaggugagcagggcggg

SEQ ID NO: 12162 - RNA, 18 nt, Artificial Sequence
  Synthetic
gcagggcggggggagggg

SEQ ID NO: 12163 - RNA, 19 nt, Artificial Sequence
  Synthetic
agcagggcggggggagggg

SEQ ID NO: 12164 - RNA, 20 nt, Artificial Sequence
  Synthetic
gagcagggcggggggagggg

SEQ ID NO: 12165 - RNA, 21 nt, Artificial Sequence
  Synthetic
ugagcagggcggggggagggg

SEQ ID NO: 12166 - RNA, 22 nt, Artificial Sequence
  Synthetic
gugagcagggcggggggagggg

SEQ ID NO: 12167 - RNA, 23 nt, Artificial Sequence
  Synthetic
ggugagcagggcggggggagggg

SEQ ID NO: 12168 - RNA, 24 nt, Artificial Sequence
  Synthetic
aggugagcagggcggggggagggg

SEQ ID NO: 12169 - RNA, 18 nt, Artificial Sequence
  Synthetic
cauugauacacaccgggg

SEQ ID NO: 12170 - RNA, 19 nt, Artificial Sequence
  Synthetic
gcauugauacacaccgggg

SEQ ID NO: 12171 - RNA, 20 nt, Artificial Sequence
  Synthetic
agcauugauacacaccgggg

SEQ ID NO: 12172 - RNA, 21 nt, Artificial Sequence
  Synthetic
gagcauugauacacaccgggg

SEQ ID NO: 12173 - RNA, 22 nt, Artificial Sequence
  Synthetic
ugagcauugauacacaccgggg

SEQ ID NO: 12174 - RNA, 23 nt, Artificial Sequence
  Synthetic
cugagcauugauacacaccgggg

SEQ ID NO: 12175 - RNA, 24 nt, Artificial Sequence
  Synthetic
ccugagcauugauacacaccgggg

SEQ ID NO: 12176 - RNA, 18 nt, Artificial Sequence
  Synthetic
auugauacacaccggggg

SEQ ID NO: 12177 - RNA, 19 nt, Artificial Sequence
  Synthetic
cauugauacacaccggggg

SEQ ID NO: 12178 - RNA, 21 nt, Artificial Sequence
  Synthetic
agcauugauacacaccggggg

SEQ ID NO: 12179 - RNA, 22 nt, Artificial Sequence
  Synthetic
gagcauugauacacaccggggg

SEQ ID NO: 12180 - RNA, 23 nt, Artificial Sequence
  Synthetic
ugagcauugauacacaccggggg

SEQ ID NO: 12181 - RNA, 24 nt, Artificial Sequence
  Synthetic
cugagcauugauacacaccggggg

SEQ ID NO: 12182 - RNA, 18 nt, Artificial Sequence
  Synthetic
aggugagcagggcggggg

SEQ ID NO: 12183 - RNA, 19 nt, Artificial Sequence
  Synthetic
aaggugagcagggcggggg

SEQ ID NO: 12184 - RNA, 20 nt, Artificial Sequence
  Synthetic
aaaggugagcagggcggggg

SEQ ID NO: 12185 - RNA, 21 nt, Artificial Sequence
  Synthetic
uaaaggugagcagggcggggg

SEQ ID NO: 12186 - RNA, 22 nt, Artificial Sequence
  Synthetic
uuaaaggugagcagggcggggg

SEQ ID NO: 12187 - RNA, 23 nt, Artificial Sequence
  Synthetic
auuaaaggugagcagggcggggg

SEQ ID NO: 12188 - RNA, 24 nt, Artificial Sequence
  Synthetic
aauuaaaggugagcagggcggggg

SEQ ID NO: 12189 - RNA, 18 nt, Artificial Sequence
  Synthetic
ggugagcagggcgggggg

SEQ ID NO: 12190 - RNA, 19 nt, Artificial Sequence
  Synthetic
aggugagcagggcgggggg

SEQ ID NO: 12191 - RNA, 21 nt, Artificial Sequence
  Synthetic
aaaggugagcagggcgggggg

SEQ ID NO: 12192 - RNA, 22 nt, Artificial Sequence
  Synthetic
uaaaggugagcagggcgggggg

SEQ ID NO: 12193 - RNA, 23 nt, Artificial Sequence
  Synthetic
uuaaaggugagcagggcgggggg

SEQ ID NO: 12194 - RNA, 24 nt, Artificial Sequence
  Synthetic
auuaaaggugagcagggcgggggg

SEQ ID NO: 12195 - RNA, 18 nt, Artificial Sequence
  Synthetic
gccuagacaggcccuggg

SEQ ID NO: 12196 - RNA, 19 nt, Artificial Sequence
  Synthetic
cgccuagacaggcccuggg

SEQ ID NO: 12197 - RNA, 21 nt, Artificial Sequence
  Synthetic
cacgccuagacaggcccuggg

SEQ ID NO: 12198 - RNA, 22 nt, Artificial Sequence
  Synthetic
acacgccuagacaggcccuggg

SEQ ID NO: 12199 - RNA, 23 nt, Artificial Sequence
  Synthetic
cacacgccuagacaggcccuggg

SEQ ID NO: 12200 - RNA, 24 nt, Artificial Sequence
  Synthetic
gcacacgccuagacaggcccuggg

SEQ ID NO: 12201 - RNA, 18 nt, Artificial Sequence
  Synthetic
aggcugagagggccuggg

SEQ ID NO: 12202 - RNA, 19 nt, Artificial Sequence
  Synthetic
caggcugagagggccuggg

SEQ ID NO: 12203 - RNA, 21 nt, Artificial Sequence
  Synthetic
gccaggcugagagggccuggg

SEQ ID NO: 12204 - RNA, 22 nt, Artificial Sequence
  Synthetic
agccaggcugagagggccuggg

SEQ ID NO: 12205 - RNA, 23 nt, Artificial Sequence
  Synthetic
cagccaggcugagagggccuggg

SEQ ID NO: 12206 - RNA, 24 nt, Artificial Sequence
  Synthetic
ccagccaggcugagagggccuggg

SEQ ID NO: 12207 - RNA, 18 nt, Artificial Sequence
  Synthetic
gagaaggcggacucuggg

SEQ ID NO: 12208 - RNA, 19 nt, Artificial Sequence
  Synthetic
ugagaaggcggacucuggg

SEQ ID NO: 12209 - RNA, 20 nt, Artificial Sequence
  Synthetic
cugagaaggcggacucuggg

SEQ ID NO: 12210 - RNA, 21 nt, Artificial Sequence
  Synthetic
ccugagaaggcggacucuggg

SEQ ID NO: 12211 - RNA, 22 nt, Artificial Sequence
  Synthetic
accugagaaggcggacucuggg

SEQ ID NO: 12212 - RNA, 23 nt, Artificial Sequence
  Synthetic
gaccugagaaggcggacucuggg

SEQ ID NO: 12213 - RNA, 24 nt, Artificial Sequence
  Synthetic
ggaccugagaaggcggacucuggg

SEQ ID NO: 12214 - RNA, 18 nt, Artificial Sequence
  Synthetic
acagagagauagggaugg

SEQ ID NO: 12215 - RNA, 19 nt, Artificial Sequence
  Synthetic
gacagagagauagggaugg

SEQ ID NO: 12216 - RNA, 21 nt, Artificial Sequence
  Synthetic
aggacagagagauagggaugg

SEQ ID NO: 12217 - RNA, 22 nt, Artificial Sequence
  Synthetic
aaggacagagagauagggaugg

SEQ ID NO: 12218 - RNA, 23 nt, Artificial Sequence
  Synthetic
gaaggacagagagauagggaugg

SEQ ID NO: 12219 - RNA, 24 nt, Artificial Sequence
  Synthetic
cgaaggacagagagauagggaugg

SEQ ID NO: 12220 - RNA, 18 nt, Artificial Sequence
  Synthetic
cgccuagacaggcccugg

SEQ ID NO: 12221 - RNA, 19 nt, Artificial Sequence
  Synthetic
acgccuagacaggcccugg

SEQ ID NO: 12222 - RNA, 20 nt, Artificial Sequence
  Synthetic
cacgccuagacaggcccugg

SEQ ID NO: 12223 - RNA, 21 nt, Artificial Sequence
  Synthetic
acacgccuagacaggcccugg

SEQ ID NO: 12224 - RNA, 22 nt, Artificial Sequence
  Synthetic
cacacgccuagacaggcccugg

SEQ ID NO: 12225 - RNA, 23 nt, Artificial Sequence
  Synthetic
gcacacgccuagacaggcccugg

SEQ ID NO: 12226 - RNA, 24 nt, Artificial Sequence
  Synthetic
ggcacacgccuagacaggcccugg

SEQ ID NO: 12227 - RNA, 18 nt, Artificial Sequence
  Synthetic
acaggugcagcggccugg

SEQ ID NO: 12228 - RNA, 19 nt, Artificial Sequence
  Synthetic
gacaggugcagcggccugg

SEQ ID NO: 12229 - RNA, 20 nt, Artificial Sequence
  Synthetic
ugacaggugcagcggccugg

SEQ ID NO: 12230 - RNA, 21 nt, Artificial Sequence
  Synthetic
cugacaggugcagcggccugg

SEQ ID NO: 12231 - RNA, 22 nt, Artificial Sequence
  Synthetic
ccugacaggugcagcggccugg

SEQ ID NO: 12232 - RNA, 23 nt, Artificial Sequence
  Synthetic
accugacaggugcagcggccugg

SEQ ID NO: 12233 - RNA, 24 nt, Artificial Sequence
  Synthetic
caccugacaggugcagcggccugg

SEQ ID NO: 12234 - RNA, 18 nt, Artificial Sequence
  Synthetic
caggcugagagggccugg

SEQ ID NO: 12235 - RNA, 19 nt, Artificial Sequence
  Synthetic
ccaggcugagagggccugg

SEQ ID NO: 12236 - RNA, 20 nt, Artificial Sequence
  Synthetic
gccaggcugagagggccugg

SEQ ID NO: 12237 - RNA, 21 nt, Artificial Sequence
  Synthetic
agccaggcugagagggccugg

SEQ ID NO: 12238 - RNA, 22 nt, Artificial Sequence
  Synthetic
cagccaggcugagagggccugg

SEQ ID NO: 12239 - RNA, 23 nt, Artificial Sequence
  Synthetic
ccagccaggcugagagggccugg

SEQ ID NO: 12240 - RNA, 24 nt, Artificial Sequence
  Synthetic
gccagccaggcugagagggccugg

SEQ ID NO: 12241 - RNA, 18 nt, Artificial Sequence
  Synthetic
agacccaaaaagggcugg

SEQ ID NO: 12242 - RNA, 19 nt, Artificial Sequence
  Synthetic
cagacccaaaaagggcugg

SEQ ID NO: 12243 - RNA, 21 nt, Artificial Sequence
  Synthetic
aucagacccaaaaagggcugg

SEQ ID NO: 12244 - RNA, 22 nt, Artificial Sequence
  Synthetic
aaucagacccaaaaagggcugg

SEQ ID NO: 12245 - RNA, 23 nt, Artificial Sequence
  Synthetic
gaaucagacccaaaaagggcugg

SEQ ID NO: 12246 - RNA, 24 nt, Artificial Sequence
  Synthetic
agaaucagacccaaaaagggcugg

SEQ ID NO: 12247 - RNA, 18 nt, Artificial Sequence
  Synthetic
gcagguggggggcagugg

SEQ ID NO: 12248 - RNA, 19 nt, Artificial Sequence
  Synthetic
ggcagguggggggcagugg

SEQ ID NO: 12249 - RNA, 21 nt, Artificial Sequence
  Synthetic
gaggcagguggggggcagugg

SEQ ID NO: 12250 - RNA, 22 nt, Artificial Sequence
  Synthetic
agaggcagguggggggcagugg

SEQ ID NO: 12251 - RNA, 23 nt, Artificial Sequence
  Synthetic
uagaggcagguggggggcagugg

SEQ ID NO: 12252 - RNA, 24 nt, Artificial Sequence
  Synthetic
guagaggcagguggggggcagugg

SEQ ID NO: 12253 - RNA, 18 nt, Artificial Sequence
  Synthetic
uucuucauuguccuaaug

SEQ ID NO: 12254 - RNA, 19 nt, Artificial Sequence
  Synthetic
uuucuucauuguccuaaug

SEQ ID NO: 12255 - RNA, 20 nt, Artificial Sequence
  Synthetic
uuuucuucauuguccuaaug

SEQ ID NO: 12256 - RNA, 21 nt, Artificial Sequence
  Synthetic
uuuuucuucauuguccuaaug

SEQ ID NO: 12257 - RNA, 22 nt, Artificial Sequence
  Synthetic
auuuuucuucauuguccuaaug

SEQ ID NO: 12258 - RNA, 23 nt, Artificial Sequence
  Synthetic
gauuuuucuucauuguccuaaug

SEQ ID NO: 12259 - RNA, 24 nt, Artificial Sequence
  Synthetic
ggauuuuucuucauuguccuaaug

SEQ ID NO: 12260 - RNA, 18 nt, Artificial Sequence
  Synthetic
gacagagagauagggaug

SEQ ID NO: 12261 - RNA, 19 nt, Artificial Sequence
  Synthetic
ggacagagagauagggaug

SEQ ID NO: 12262 - RNA, 20 nt, Artificial Sequence
  Synthetic
aggacagagagauagggaug

SEQ ID NO: 12263 - RNA, 21 nt, Artificial Sequence
  Synthetic
aaggacagagagauagggaug

SEQ ID NO: 12264 - RNA, 22 nt, Artificial Sequence
  Synthetic
gaaggacagagagauagggaug

SEQ ID NO: 12265 - RNA, 23 nt, Artificial Sequence
  Synthetic
cgaaggacagagagauagggaug

SEQ ID NO: 12266 - RNA, 24 nt, Artificial Sequence
  Synthetic
gcgaaggacagagagauagggaug

SEQ ID NO: 12267 - RNA, 18 nt, Artificial Sequence
  Synthetic
gagccuaggggcucacug

SEQ ID NO: 12268 - RNA, 19 nt, Artificial Sequence
  Synthetic
ggagccuaggggcucacug

SEQ ID NO: 12269 - RNA, 20 nt, Artificial Sequence
  Synthetic
gggagccuaggggcucacug

SEQ ID NO: 12270 - RNA, 21 nt, Artificial Sequence
  Synthetic
ggggagccuaggggcucacug

SEQ ID NO: 12271 - RNA, 22 nt, Artificial Sequence
  Synthetic
aggggagccuaggggcucacug

SEQ ID NO: 12272 - RNA, 23 nt, Artificial Sequence
  Synthetic
uaggggagccuaggggcucacug

SEQ ID NO: 12273 - RNA, 24 nt, Artificial Sequence
  Synthetic
cuaggggagccuaggggcucacug

SEQ ID NO: 12274 - RNA, 18 nt, Artificial Sequence
  Synthetic
gucucugccccaggacug

SEQ ID NO: 12275 - RNA, 19 nt, Artificial Sequence
  Synthetic
ugucucugccccaggacug

SEQ ID NO: 12276 - RNA, 20 nt, Artificial Sequence
  Synthetic
cugucucugccccaggacug

SEQ ID NO: 12277 - RNA, 21 nt, Artificial Sequence
  Synthetic
ucugucucugccccaggacug

SEQ ID NO: 12278 - RNA, 22 nt, Artificial Sequence
  Synthetic
uucugucucugccccaggacug

SEQ ID NO: 12279 - RNA, 23 nt, Artificial Sequence
  Synthetic
auucugucucugccccaggacug

SEQ ID NO: 12280 - RNA, 24 nt, Artificial Sequence
  Synthetic
gauucugucucugccccaggacug

SEQ ID NO: 12281 - RNA, 18 nt, Artificial Sequence
  Synthetic
cuggagccagcagaccug

SEQ ID NO: 12282 - RNA, 19 nt, Artificial Sequence
  Synthetic
ccuggagccagcagaccug

SEQ ID NO: 12283 - RNA, 21 nt, Artificial Sequence
  Synthetic
uuccuggagccagcagaccug

SEQ ID NO: 12284 - RNA, 22 nt, Artificial Sequence
  Synthetic
uuuccuggagccagcagaccug

SEQ ID NO: 12285 - RNA, 23 nt, Artificial Sequence
  Synthetic
cuuuccuggagccagcagaccug

SEQ ID NO: 12286 - RNA, 24 nt, Artificial Sequence
  Synthetic
ccuuuccuggagccagcagaccug

SEQ ID NO: 12287 - RNA, 18 nt, Artificial Sequence
  Synthetic
ccucacccucaggcccug

SEQ ID NO: 12288 - RNA, 19 nt, Artificial Sequence
  Synthetic
gccucacccucaggcccug

SEQ ID NO: 12289 - RNA, 20 nt, Artificial Sequence
  Synthetic
agccucacccucaggcccug

SEQ ID NO: 12290 - RNA, 21 nt, Artificial Sequence
  Synthetic
cagccucacccucaggcccug

SEQ ID NO: 12291 - RNA, 22 nt, Artificial Sequence
  Synthetic
ucagccucacccucaggcccug

SEQ ID NO: 12292 - RNA, 23 nt, Artificial Sequence
  Synthetic
gucagccucacccucaggcccug

SEQ ID NO: 12293 - RNA, 24 nt, Artificial Sequence
  Synthetic
ggucagccucacccucaggcccug

SEQ ID NO: 12294 - RNA, 18 nt, Artificial Sequence
  Synthetic
agacaggcaaggaggcug

SEQ ID NO: 12295 - RNA, 19 nt, Artificial Sequence
  Synthetic
cagacaggcaaggaggcug

SEQ ID NO: 12296 - RNA, 21 nt, Artificial Sequence
  Synthetic
cgcagacaggcaaggaggcug

SEQ ID NO: 12297 - RNA, 22 nt, Artificial Sequence
  Synthetic
acgcagacaggcaaggaggcug

SEQ ID NO: 12298 - RNA, 23 nt, Artificial Sequence
  Synthetic
gacgcagacaggcaaggaggcug

SEQ ID NO: 12299 - RNA, 24 nt, Artificial Sequence
  Synthetic
agacgcagacaggcaaggaggcug

SEQ ID NO: 12300 - RNA, 18 nt, Artificial Sequence
  Synthetic
cagacccaaaaagggcug

SEQ ID NO: 12301 - RNA, 19 nt, Artificial Sequence
  Synthetic
ucagacccaaaaagggcug

SEQ ID NO: 12302 - RNA, 20 nt, Artificial Sequence
  Synthetic
aucagacccaaaaagggcug

SEQ ID NO: 12303 - RNA, 21 nt, Artificial Sequence
  Synthetic
aaucagacccaaaaagggcug

SEQ ID NO: 12304 - RNA, 22 nt, Artificial Sequence
  Synthetic
gaaucagacccaaaaagggcug

SEQ ID NO: 12305 - RNA, 23 nt, Artificial Sequence
  Synthetic
agaaucagacccaaaaagggcug

SEQ ID NO: 12306 - RNA, 24 nt, Artificial Sequence
  Synthetic
gagaaucagacccaaaaagggcug

SEQ ID NO: 12307 - RNA, 18 nt, Artificial Sequence
  Synthetic
gggcggggggaggggcug

SEQ ID NO: 12308 - RNA, 19 nt, Artificial Sequence
  Synthetic
agggcggggggaggggcug

SEQ ID NO: 12309 - RNA, 21 nt, Artificial Sequence
  Synthetic
gcagggcggggggaggggcug

SEQ ID NO: 12310 - RNA, 22 nt, Artificial Sequence
  Synthetic
agcagggcggggggaggggcug

SEQ ID NO: 12311 - RNA, 23 nt, Artificial Sequence
  Synthetic
gagcagggcggggggaggggcug

SEQ ID NO: 12312 - RNA, 24 nt, Artificial Sequence
  Synthetic
ugagcagggcggggggaggggcug

SEQ ID NO: 12313 - RNA, 18 nt, Artificial Sequence
  Synthetic
ggugcagcggccuggcug

SEQ ID NO: 12314 - RNA, 19 nt, Artificial Sequence
  Synthetic
aggugcagcggccuggcug

SEQ ID NO: 12315 - RNA, 21 nt, Artificial Sequence
  Synthetic
acaggugcagcggccuggcug

SEQ ID NO: 12316 - RNA, 22 nt, Artificial Sequence
  Synthetic
gacaggugcagcggccuggcug

SEQ ID NO: 12317 - RNA, 23 nt, Artificial Sequence
  Synthetic
ugacaggugcagcggccuggcug

SEQ ID NO: 12318 - RNA, 24 nt, Artificial Sequence
  Synthetic
cugacaggugcagcggccuggcug

SEQ ID NO: 12319 - RNA, 18 nt, Artificial Sequence
  Synthetic
gaguuggggccaaaagug

SEQ ID NO: 12320 - RNA, 19 nt, Artificial Sequence
  Synthetic
ggaguuggggccaaaagug

SEQ ID NO: 12321 - RNA, 20 nt, Artificial Sequence
  Synthetic
gggaguuggggccaaaagug

SEQ ID NO: 12322 - RNA, 21 nt, Artificial Sequence
  Synthetic
cgggaguuggggccaaaagug

SEQ ID NO: 12323 - RNA, 22 nt, Artificial Sequence
  Synthetic
gcgggaguuggggccaaaagug

SEQ ID NO: 12324 - RNA, 23 nt, Artificial Sequence
  Synthetic
ugcgggaguuggggccaaaagug

SEQ ID NO: 12325 - RNA, 24 nt, Artificial Sequence
  Synthetic
cugcgggaguuggggccaaaagug

SEQ ID NO: 12326 - RNA, 18 nt, Artificial Sequence
  Synthetic
ggaguggagugccaagug

SEQ ID NO: 12327 - RNA, 19 nt, Artificial Sequence
  Synthetic
aggaguggagugccaagug

SEQ ID NO: 12328 - RNA, 20 nt, Artificial Sequence
  Synthetic
aaggaguggagugccaagug

SEQ ID NO: 12329 - RNA, 21 nt, Artificial Sequence
  Synthetic
uaaggaguggagugccaagug

SEQ ID NO: 12330 - RNA, 22 nt, Artificial Sequence
  Synthetic
auaaggaguggagugccaagug

SEQ ID NO: 12331 - RNA, 23 nt, Artificial Sequence
  Synthetic
gauaaggaguggagugccaagug

SEQ ID NO: 12332 - RNA, 24 nt, Artificial Sequence
  Synthetic
ggauaaggaguggagugccaagug

SEQ ID NO: 12333 - RNA, 18 nt, Artificial Sequence
  Synthetic
ggcagguggggggcagug

SEQ ID NO: 12334 - RNA, 19 nt, Artificial Sequence
  Synthetic
aggcagguggggggcagug

SEQ ID NO: 12335 - RNA, 20 nt, Artificial Sequence
  Synthetic
gaggcagguggggggcagug

SEQ ID NO: 12336 - RNA, 21 nt, Artificial Sequence
  Synthetic
agaggcagguggggggcagug

SEQ ID NO: 12337 - RNA, 22 nt, Artificial Sequence
  Synthetic
uagaggcagguggggggcagug

SEQ ID NO: 12338 - RNA, 23 nt, Artificial Sequence
  Synthetic
guagaggcagguggggggcagug

SEQ ID NO: 12339 - RNA, 24 nt, Artificial Sequence
  Synthetic
aguagaggcagguggggggcagug

SEQ ID NO: 12340 - RNA, 18 nt, Artificial Sequence
  Synthetic
aggaggcagcccagagug

SEQ ID NO: 12341 - RNA, 19 nt, Artificial Sequence
  Synthetic
caggaggcagcccagagug

SEQ ID NO: 12342 - RNA, 20 nt, Artificial Sequence
  Synthetic
acaggaggcagcccagagug

SEQ ID NO: 12343 - RNA, 21 nt, Artificial Sequence
  Synthetic
cacaggaggcagcccagagug

SEQ ID NO: 12344 - RNA, 22 nt, Artificial Sequence
  Synthetic
ccacaggaggcagcccagagug

SEQ ID NO: 12345 - RNA, 23 nt, Artificial Sequence
  Synthetic
cccacaggaggcagcccagagug

SEQ ID NO: 12346 - RNA, 24 nt, Artificial Sequence
  Synthetic
ccccacaggaggcagcccagagug

SEQ ID NO: 12347 - RNA, 18 nt, Artificial Sequence
  Synthetic
aagcaggcacugaaggug

SEQ ID NO: 12348 - RNA, 19 nt, Artificial Sequence
  Synthetic
aaagcaggcacugaaggug

SEQ ID NO: 12349 - RNA, 20 nt, Artificial Sequence
  Synthetic
gaaagcaggcacugaaggug

SEQ ID NO: 12350 - RNA, 21 nt, Artificial Sequence
  Synthetic
ggaaagcaggcacugaaggug

SEQ ID NO: 12351 - RNA, 22 nt, Artificial Sequence
  Synthetic
gggaaagcaggcacugaaggug

SEQ ID NO: 12352 - RNA, 23 nt, Artificial Sequence
  Synthetic
agggaaagcaggcacugaaggug

SEQ ID NO: 12353 - RNA, 24 nt, Artificial Sequence
  Synthetic
cagggaaagcaggcacugaaggug

SEQ ID NO: 12354 - RNA, 18 nt, Artificial Sequence
  Synthetic
agugaguagaggcaggug

SEQ ID NO: 12355 - RNA, 19 nt, Artificial Sequence
  Synthetic
gagugaguagaggcaggug

SEQ ID NO: 12356 - RNA, 21 nt, Artificial Sequence
  Synthetic
cugagugaguagaggcaggug

SEQ ID NO: 12357 - RNA, 22 nt, Artificial Sequence
  Synthetic
acugagugaguagaggcaggug

SEQ ID NO: 12358 - RNA, 23 nt, Artificial Sequence
  Synthetic
cacugagugaguagaggcaggug

SEQ ID NO: 12359 - RNA, 24 nt, Artificial Sequence
  Synthetic
gcacugagugaguagaggcaggug

SEQ ID NO: 12360 - RNA, 18 nt, Artificial Sequence
  Synthetic
gggacaggauggcaggug

SEQ ID NO: 12361 - RNA, 19 nt, Artificial Sequence
  Synthetic
ggggacaggauggcaggug

SEQ ID NO: 12362 - RNA, 21 nt, Artificial Sequence
  Synthetic
ugggggacaggauggcaggug

SEQ ID NO: 12363 - RNA, 22 nt, Artificial Sequence
  Synthetic
cugggggacaggauggcaggug

SEQ ID NO: 12364 - RNA, 23 nt, Artificial Sequence
  Synthetic
gcugggggacaggauggcaggug

SEQ ID NO: 12365 - RNA, 24 nt, Artificial Sequence
  Synthetic
ggcugggggacaggauggcaggug

SEQ ID NO: 12366 - RNA, 18 nt, Artificial Sequence
  Synthetic
gcugagagggccugggug

SEQ ID NO: 12367 - RNA, 19 nt, Artificial Sequence
  Synthetic
ggcugagagggccugggug

SEQ ID NO: 12368 - RNA, 21 nt, Artificial Sequence
  Synthetic
caggcugagagggccugggug

SEQ ID NO: 12369 - RNA, 22 nt, Artificial Sequence
  Synthetic
ccaggcugagagggccugggug

SEQ ID NO: 12370 - RNA, 23 nt, Artificial Sequence
  Synthetic
gccaggcugagagggccugggug

SEQ ID NO: 12371 - RNA, 24 nt, Artificial Sequence
  Synthetic
agccaggcugagagggccugggug

SEQ ID NO: 12372 - RNA, 18 nt, Artificial Sequence
  Synthetic
gcuguggucacagaguug

SEQ ID NO: 12373 - RNA, 19 nt, Artificial Sequence
  Synthetic
ugcuguggucacagaguug

SEQ ID NO: 12374 - RNA, 20 nt, Artificial Sequence
  Synthetic
cugcuguggucacagaguug

SEQ ID NO: 12375 - RNA, 21 nt, Artificial Sequence
  Synthetic
ccugcuguggucacagaguug

SEQ ID NO: 12376 - RNA, 22 nt, Artificial Sequence
  Synthetic
cccugcuguggucacagaguug

SEQ ID NO: 12377 - RNA, 23 nt, Artificial Sequence
  Synthetic
ccccugcuguggucacagaguug

SEQ ID NO: 12378 - RNA, 24 nt, Artificial Sequence
  Synthetic
gccccugcuguggucacagaguug

SEQ ID NO: 12379 - RNA, 18 nt, Artificial Sequence
  Synthetic
aggaggagaaauucguug

SEQ ID NO: 12380 - RNA, 19 nt, Artificial Sequence
  Synthetic
gaggaggagaaauucguug

SEQ ID NO: 12381 - RNA, 20 nt, Artificial Sequence
  Synthetic
ggaggaggagaaauucguug

SEQ ID NO: 12382 - RNA, 21 nt, Artificial Sequence
  Synthetic
gggaggaggagaaauucguug

SEQ ID NO: 12383 - RNA, 22 nt, Artificial Sequence
  Synthetic
ugggaggaggagaaauucguug

SEQ ID NO: 12384 - RNA, 23 nt, Artificial Sequence
  Synthetic
cugggaggaggagaaauucguug

SEQ ID NO: 12385 - RNA, 24 nt, Artificial Sequence
  Synthetic
ccugggaggaggagaaauucguug

SEQ ID NO: 12386 - RNA, 18 nt, Artificial Sequence
  Synthetic
gagguuagaaaacaaaau

SEQ ID NO: 12387 - RNA, 19 nt, Artificial Sequence
  Synthetic
ugagguuagaaaacaaaau

SEQ ID NO: 12388 - RNA, 21 nt, Artificial Sequence
  Synthetic
ucugagguuagaaaacaaaau

SEQ ID NO: 12389 - RNA, 22 nt, Artificial Sequence
  Synthetic
uucugagguuagaaaacaaaau

SEQ ID NO: 12390 - RNA, 23 nt, Artificial Sequence
  Synthetic
uuucugagguuagaaaacaaaau

SEQ ID NO: 12391 - RNA, 24 nt, Artificial Sequence
  Synthetic
uuuucugagguuagaaaacaaaau

SEQ ID NO: 12392 - RNA, 18 nt, Artificial Sequence
  Synthetic
ucacagaguugcaggaau

SEQ ID NO: 12393 - RNA, 19 nt, Artificial Sequence
  Synthetic
gucacagaguugcaggaau

SEQ ID NO: 12394 - RNA, 20 nt, Artificial Sequence
  Synthetic
ggucacagaguugcaggaau

SEQ ID NO: 12395 - RNA, 21 nt, Artificial Sequence
  Synthetic
uggucacagaguugcaggaau

SEQ ID NO: 12396 - RNA, 22 nt, Artificial Sequence
  Synthetic
guggucacagaguugcaggaau

SEQ ID NO: 12397 - RNA, 23 nt, Artificial Sequence
  Synthetic
uguggucacagaguugcaggaau

SEQ ID NO: 12398 - RNA, 24 nt, Artificial Sequence
  Synthetic
cuguggucacagaguugcaggaau

SEQ ID NO: 12399 - RNA, 18 nt, Artificial Sequence
  Synthetic
uucucagagauaagacau

SEQ ID NO: 12400 - RNA, 19 nt, Artificial Sequence
  Synthetic
uuucucagagauaagacau

SEQ ID NO: 12401 - RNA, 20 nt, Artificial Sequence
  Synthetic
auuucucagagauaagacau

SEQ ID NO: 12402 - RNA, 21 nt, Artificial Sequence
  Synthetic
gauuucucagagauaagacau

SEQ ID NO: 12403 - RNA, 22 nt, Artificial Sequence
  Synthetic
agauuucucagagauaagacau

SEQ ID NO: 12404 - RNA, 23 nt, Artificial Sequence
  Synthetic
cagauuucucagagauaagacau

SEQ ID NO: 12405 - RNA, 24 nt, Artificial Sequence
  Synthetic
ucagauuucucagagauaagacau

SEQ ID NO: 12406 - RNA, 18 nt, Artificial Sequence
  Synthetic
uuccugagacagacucau

SEQ ID NO: 12407 - RNA, 19 nt, Artificial Sequence
  Synthetic
cuuccugagacagacucau

SEQ ID NO: 12408 - RNA, 21 nt, Artificial Sequence
  Synthetic
uacuuccugagacagacucau

SEQ ID NO: 12409 - RNA, 22 nt, Artificial Sequence
  Synthetic
uuacuuccugagacagacucau

SEQ ID NO: 12410 - RNA, 23 nt, Artificial Sequence
  Synthetic
uuuacuuccugagacagacucau

SEQ ID NO: 12411 - RNA, 24 nt, Artificial Sequence
  Synthetic
auuuacuuccugagacagacucau

SEQ ID NO: 12412 - RNA, 18 nt, Artificial Sequence
  Synthetic
caggugaggggcaaagau

SEQ ID NO: 12413 - RNA, 19 nt, Artificial Sequence
  Synthetic
gcaggugaggggcaaagau

SEQ ID NO: 12414 - RNA, 20 nt, Artificial Sequence
  Synthetic
ggcaggugaggggcaaagau

SEQ ID NO: 12415 - RNA, 21 nt, Artificial Sequence
  Synthetic
uggcaggugaggggcaaagau

SEQ ID NO: 12416 - RNA, 22 nt, Artificial Sequence
  Synthetic
auggcaggugaggggcaaagau

SEQ ID NO: 12417 - RNA, 23 nt, Artificial Sequence
  Synthetic
gauggcaggugaggggcaaagau

SEQ ID NO: 12418 - RNA, 24 nt, Artificial Sequence
  Synthetic
ggauggcaggugaggggcaaagau

SEQ ID NO: 12419 - RNA, 18 nt, Artificial Sequence
  Synthetic
uuaaugcagcaaaaggau

SEQ ID NO: 12420 - RNA, 19 nt, Artificial Sequence
  Synthetic
cuuaaugcagcaaaaggau

SEQ ID NO: 12421 - RNA, 20 nt, Artificial Sequence
  Synthetic
acuuaaugcagcaaaaggau

SEQ ID NO: 12422 - RNA, 21 nt, Artificial Sequence
  Synthetic
aacuuaaugcagcaaaaggau

SEQ ID NO: 12423 - RNA, 22 nt, Artificial Sequence
  Synthetic
aaacuuaaugcagcaaaaggau

SEQ ID NO: 12424 - RNA, 23 nt, Artificial Sequence
  Synthetic
caaacuuaaugcagcaaaaggau

SEQ ID NO: 12425 - RNA, 24 nt, Artificial Sequence
  Synthetic
ccaaacuuaaugcagcaaaaggau

SEQ ID NO: 12426 - RNA, 18 nt, Artificial Sequence
  Synthetic
gacagacucaugggggau

SEQ ID NO: 12427 - RNA, 19 nt, Artificial Sequence
  Synthetic
agacagacucaugggggau

SEQ ID NO: 12428 - RNA, 21 nt, Artificial Sequence
  Synthetic
ugagacagacucaugggggau

SEQ ID NO: 12429 - RNA, 22 nt, Artificial Sequence
  Synthetic
cugagacagacucaugggggau

SEQ ID NO: 12430 - RNA, 23 nt, Artificial Sequence
  Synthetic
ccugagacagacucaugggggau

SEQ ID NO: 12431 - RNA, 24 nt, Artificial Sequence
  Synthetic
uccugagacagacucaugggggau

SEQ ID NO: 12432 - RNA, 18 nt, Artificial Sequence
  Synthetic
gcucaggugcaccuggau

SEQ ID NO: 12433 - RNA, 19 nt, Artificial Sequence
  Synthetic
ggcucaggugcaccuggau

SEQ ID NO: 12434 - RNA, 20 nt, Artificial Sequence
  Synthetic
gggcucaggugcaccuggau

SEQ ID NO: 12435 - RNA, 21 nt, Artificial Sequence
  Synthetic
ggggcucaggugcaccuggau

SEQ ID NO: 12436 - RNA, 22 nt, Artificial Sequence
  Synthetic
cggggcucaggugcaccuggau

SEQ ID NO: 12437 - RNA, 23 nt, Artificial Sequence
  Synthetic
ucggggcucaggugcaccuggau

SEQ ID NO: 12438 - RNA, 24 nt, Artificial Sequence
  Synthetic
aucggggcucaggugcaccuggau

SEQ ID NO: 12439 - RNA, 18 nt, Artificial Sequence
  Synthetic
agggccacgcaggacacu

SEQ ID NO: 12440 - RNA, 19 nt, Artificial Sequence
  Synthetic
gagggccacgcaggacacu

SEQ ID NO: 12441 - RNA, 20 nt, Artificial Sequence
  Synthetic
cgagggccacgcaggacacu

SEQ ID NO: 12442 - RNA, 21 nt, Artificial Sequence
  Synthetic
gcgagggccacgcaggacacu

SEQ ID NO: 12443 - RNA, 22 nt, Artificial Sequence
  Synthetic
cgcgagggccacgcaggacacu

SEQ ID NO: 12444 - RNA, 23 nt, Artificial Sequence
  Synthetic
gcgcgagggccacgcaggacacu

SEQ ID NO: 12445 - RNA, 24 nt, Artificial Sequence
  Synthetic
agcgcgagggccacgcaggacacu

SEQ ID NO: 12446 - RNA, 18 nt, Artificial Sequence
  Synthetic
ggcucacugcaggagacu

SEQ ID NO: 12447 - RNA, 19 nt, Artificial Sequence
  Synthetic
gggcucacugcaggagacu

SEQ ID NO: 12448 - RNA, 20 nt, Artificial Sequence
  Synthetic
ggggcucacugcaggagacu

SEQ ID NO: 12449 - RNA, 21 nt, Artificial Sequence
  Synthetic
aggggcucacugcaggagacu

SEQ ID NO: 12450 - RNA, 22 nt, Artificial Sequence
  Synthetic
uaggggcucacugcaggagacu

SEQ ID NO: 12451 - RNA, 23 nt, Artificial Sequence
  Synthetic
cuaggggcucacugcaggagacu

SEQ ID NO: 12452 - RNA, 24 nt, Artificial Sequence
  Synthetic
ccuaggggcucacugcaggagacu

SEQ ID NO: 12453 - RNA, 18 nt, Artificial Sequence
  Synthetic
aaagggcuggaggagacu

SEQ ID NO: 12454 - RNA, 19 nt, Artificial Sequence
  Synthetic
aaaagggcuggaggagacu

SEQ ID NO: 12455 - RNA, 21 nt, Artificial Sequence
  Synthetic
caaaaagggcuggaggagacu

SEQ ID NO: 12456 - RNA, 22 nt, Artificial Sequence
  Synthetic
ccaaaaagggcuggaggagacu

SEQ ID NO: 12457 - RNA, 23 nt, Artificial Sequence
  Synthetic
cccaaaaagggcuggaggagacu

SEQ ID NO: 12458 - RNA, 24 nt, Artificial Sequence
  Synthetic
acccaaaaagggcuggaggagacu

SEQ ID NO: 12459 - RNA, 18 nt, Artificial Sequence
  Synthetic
gaccugagaaggcggacu

SEQ ID NO: 12460 - RNA, 19 nt, Artificial Sequence
  Synthetic
ggaccugagaaggcggacu

SEQ ID NO: 12461 - RNA, 20 nt, Artificial Sequence
  Synthetic
uggaccugagaaggcggacu

SEQ ID NO: 12462 - RNA, 21 nt, Artificial Sequence
  Synthetic
cuggaccugagaaggcggacu

SEQ ID NO: 12463 - RNA, 22 nt, Artificial Sequence
  Synthetic
acuggaccugagaaggcggacu

SEQ ID NO: 12464 - RNA, 23 nt, Artificial Sequence
  Synthetic
uacuggaccugagaaggcggacu

SEQ ID NO: 12465 - RNA, 24 nt, Artificial Sequence
  Synthetic
guacuggaccugagaaggcggacu

SEQ ID NO: 12466 - RNA, 18 nt, Artificial Sequence
  Synthetic
ccuggagccagcagaccu

SEQ ID NO: 12467 - RNA, 19 nt, Artificial Sequence
  Synthetic
uccuggagccagcagaccu

SEQ ID NO: 12468 - RNA, 20 nt, Artificial Sequence
  Synthetic
uuccuggagccagcagaccu

SEQ ID NO: 12469 - RNA, 21 nt, Artificial Sequence
  Synthetic
uuuccuggagccagcagaccu

SEQ ID NO: 12470 - RNA, 22 nt, Artificial Sequence
  Synthetic
cuuuccuggagccagcagaccu

SEQ ID NO: 12471 - RNA, 23 nt, Artificial Sequence
  Synthetic
ccuuuccuggagccagcagaccu

SEQ ID NO: 12472 - RNA, 24 nt, Artificial Sequence
  Synthetic
accuuuccuggagccagcagaccu

SEQ ID NO: 12473 - RNA, 18 nt, Artificial Sequence
  Synthetic
acugggaguacuggaccu

SEQ ID NO: 12474 - RNA, 19 nt, Artificial Sequence
  Synthetic
aacugggaguacuggaccu

SEQ ID NO: 12475 - RNA, 20 nt, Artificial Sequence
  Synthetic
gaacugggaguacuggaccu

SEQ ID NO: 12476 - RNA, 21 nt, Artificial Sequence
  Synthetic
ugaacugggaguacuggaccu

SEQ ID NO: 12477 - RNA, 22 nt, Artificial Sequence
  Synthetic
gugaacugggaguacuggaccu

SEQ ID NO: 12478 - RNA, 23 nt, Artificial Sequence
  Synthetic
ggugaacugggaguacuggaccu

SEQ ID NO: 12479 - RNA, 24 nt, Artificial Sequence
  Synthetic
aggugaacugggaguacuggaccu

SEQ ID NO: 12480 - RNA, 18 nt, Artificial Sequence
  Synthetic
cacgccuagacaggcccu

SEQ ID NO: 12481 - RNA, 19 nt, Artificial Sequence
  Synthetic
acacgccuagacaggcccu

SEQ ID NO: 12482 - RNA, 21 nt, Artificial Sequence
  Synthetic
gcacacgccuagacaggcccu

SEQ ID NO: 12483 - RNA, 22 nt, Artificial Sequence
  Synthetic
ggcacacgccuagacaggcccu

SEQ ID NO: 12484 - RNA, 23 nt, Artificial Sequence
  Synthetic
uggcacacgccuagacaggcccu

SEQ ID NO: 12485 - RNA, 24 nt, Artificial Sequence
  Synthetic
auggcacacgccuagacaggcccu

SEQ ID NO: 12486 - RNA, 18 nt, Artificial Sequence
  Synthetic
caagggcuaggggagccu

SEQ ID NO: 12487 - RNA, 19 nt, Artificial Sequence
  Synthetic
ccaagggcuaggggagccu

SEQ ID NO: 12488 - RNA, 21 nt, Artificial Sequence
  Synthetic
agccaagggcuaggggagccu

SEQ ID NO: 12489 - RNA, 22 nt, Artificial Sequence
  Synthetic
gagccaagggcuaggggagccu

SEQ ID NO: 12490 - RNA, 23 nt, Artificial Sequence
  Synthetic
agagccaagggcuaggggagccu

SEQ ID NO: 12491 - RNA, 24 nt, Artificial Sequence
  Synthetic
aagagccaagggcuaggggagccu

SEQ ID NO: 12492 - RNA, 18 nt, Artificial Sequence
  Synthetic
cagaauucuccuccuccu

SEQ ID NO: 12493 - RNA, 19 nt, Artificial Sequence
  Synthetic
ucagaauucuccuccuccu

SEQ ID NO: 12494 - RNA, 20 nt, Artificial Sequence
  Synthetic
uucagaauucuccuccuccu

SEQ ID NO: 12495 - RNA, 21 nt, Artificial Sequence
  Synthetic
auucagaauucuccuccuccu

SEQ ID NO: 12496 - RNA, 22 nt, Artificial Sequence
  Synthetic
aauucagaauucuccuccuccu

SEQ ID NO: 12497 - RNA, 23 nt, Artificial Sequence
  Synthetic
gaauucagaauucuccuccuccu

SEQ ID NO: 12498 - RNA, 24 nt, Artificial Sequence
  Synthetic
agaauucagaauucuccuccuccu

SEQ ID NO: 12499 - RNA, 18 nt, Artificial Sequence
  Synthetic
aggggcccaggugaagcu

SEQ ID NO: 12500 - RNA, 19 nt, Artificial Sequence
  Synthetic
gaggggcccaggugaagcu

SEQ ID NO: 12501 - RNA, 21 nt, Artificial Sequence
  Synthetic
gggaggggcccaggugaagcu

SEQ ID NO: 12502 - RNA, 22 nt, Artificial Sequence
  Synthetic
cgggaggggcccaggugaagcu

SEQ ID NO: 12503 - RNA, 23 nt, Artificial Sequence
  Synthetic
ccgggaggggcccaggugaagcu

SEQ ID NO: 12504 - RNA, 24 nt, Artificial Sequence
  Synthetic
cccgggaggggcccaggugaagcu

SEQ ID NO: 12505 - RNA, 18 nt, Artificial Sequence
  Synthetic
gauccugagcccacagcu

SEQ ID NO: 12506 - RNA, 19 nt, Artificial Sequence
  Synthetic
ggauccugagcccacagcu

SEQ ID NO: 12507 - RNA, 21 nt, Artificial Sequence
  Synthetic
aaggauccugagcccacagcu

SEQ ID NO: 12508 - RNA, 22 nt, Artificial Sequence
  Synthetic
gaaggauccugagcccacagcu

SEQ ID NO: 12509 - RNA, 23 nt, Artificial Sequence
  Synthetic
agaaggauccugagcccacagcu

SEQ ID NO: 12510 - RNA, 24 nt, Artificial Sequence
  Synthetic
uagaaggauccugagcccacagcu

SEQ ID NO: 12511 - RNA, 18 nt, Artificial Sequence
  Synthetic
gaaggggccagccaggcu

SEQ ID NO: 12512 - RNA, 19 nt, Artificial Sequence
  Synthetic
agaaggggccagccaggcu

SEQ ID NO: 12513 - RNA, 20 nt, Artificial Sequence
  Synthetic
gagaaggggccagccaggcu

SEQ ID NO: 12514 - RNA, 21 nt, Artificial Sequence
  Synthetic
ggagaaggggccagccaggcu

SEQ ID NO: 12515 - RNA, 22 nt, Artificial Sequence
  Synthetic
aggagaaggggccagccaggcu

SEQ ID NO: 12516 - RNA, 23 nt, Artificial Sequence
  Synthetic
aaggagaaggggccagccaggcu

SEQ ID NO: 12517 - RNA, 24 nt, Artificial Sequence
  Synthetic
caaggagaaggggccagccaggcu

SEQ ID NO: 12518 - RNA, 18 nt, Artificial Sequence
  Synthetic
cagacaggcaaggaggcu

SEQ ID NO: 12519 - RNA, 19 nt, Artificial Sequence
  Synthetic
gcagacaggcaaggaggcu

SEQ ID NO: 12520 - RNA, 21 nt, Artificial Sequence
  Synthetic
acgcagacaggcaaggaggcu

SEQ ID NO: 12521 - RNA, 22 nt, Artificial Sequence
  Synthetic
gacgcagacaggcaaggaggcu

SEQ ID NO: 12522 - RNA, 23 nt, Artificial Sequence
  Synthetic
agacgcagacaggcaaggaggcu

SEQ ID NO: 12523 - RNA, 24 nt, Artificial Sequence
  Synthetic
uagacgcagacaggcaaggaggcu

SEQ ID NO: 12524 - RNA, 18 nt, Artificial Sequence
  Synthetic
acauaagagccaagggcu

SEQ ID NO: 12525 - RNA, 19 nt, Artificial Sequence
  Synthetic
gacauaagagccaagggcu

SEQ ID NO: 12526 - RNA, 21 nt, Artificial Sequence
  Synthetic
aagacauaagagccaagggcu

SEQ ID NO: 12527 - RNA, 22 nt, Artificial Sequence
  Synthetic
uaagacauaagagccaagggcu

SEQ ID NO: 12528 - RNA, 23 nt, Artificial Sequence
  Synthetic
auaagacauaagagccaagggcu

SEQ ID NO: 12529 - RNA, 24 nt, Artificial Sequence
  Synthetic
gauaagacauaagagccaagggcu

SEQ ID NO: 12530 - RNA, 18 nt, Artificial Sequence
  Synthetic
agggcggggggaggggcu

SEQ ID NO: 12531 - RNA, 19 nt, Artificial Sequence
  Synthetic
cagggcggggggaggggcu

SEQ ID NO: 12532 - RNA, 20 nt, Artificial Sequence
  Synthetic
gcagggcggggggaggggcu

SEQ ID NO: 12533 - RNA, 21 nt, Artificial Sequence
  Synthetic
agcagggcggggggaggggcu

SEQ ID NO: 12534 - RNA, 22 nt, Artificial Sequence
  Synthetic
gagcagggcggggggaggggcu

SEQ ID NO: 12535 - RNA, 23 nt, Artificial Sequence
  Synthetic
ugagcagggcggggggaggggcu

SEQ ID NO: 12536 - RNA, 24 nt, Artificial Sequence
  Synthetic
gugagcagggcggggggaggggcu

SEQ ID NO: 12537 - RNA, 18 nt, Artificial Sequence
  Synthetic
aggugcagcggccuggcu

SEQ ID NO: 12538 - RNA, 19 nt, Artificial Sequence
  Synthetic
caggugcagcggccuggcu

SEQ ID NO: 12539 - RNA, 21 nt, Artificial Sequence
  Synthetic
gacaggugcagcggccuggcu

SEQ ID NO: 12540 - RNA, 22 nt, Artificial Sequence
  Synthetic
ugacaggugcagcggccuggcu

SEQ ID NO: 12541 - RNA, 23 nt, Artificial Sequence
  Synthetic
cugacaggugcagcggccuggcu

SEQ ID NO: 12542 - RNA, 24 nt, Artificial Sequence
  Synthetic
ccugacaggugcagcggccuggcu

SEQ ID NO: 12543 - RNA, 18 nt, Artificial Sequence
  Synthetic
uuucauaucaagggcucu

SEQ ID NO: 12544 - RNA, 19 nt, Artificial Sequence
  Synthetic
uuuucauaucaagggcucu

SEQ ID NO: 12545 - RNA, 20 nt, Artificial Sequence
  Synthetic
guuuucauaucaagggcucu

SEQ ID NO: 12546 - RNA, 21 nt, Artificial Sequence
  Synthetic
aguuuucauaucaagggcucu

SEQ ID NO: 12547 - RNA, 22 nt, Artificial Sequence
  Synthetic
uaguuuucauaucaagggcucu

SEQ ID NO: 12548 - RNA, 23 nt, Artificial Sequence
  Synthetic
auaguuuucauaucaagggcucu

SEQ ID NO: 12549 - RNA, 24 nt, Artificial Sequence
  Synthetic
aauaguuuucauaucaagggcucu

SEQ ID NO: 12550 - RNA, 18 nt, Artificial Sequence
  Synthetic
gguuaucuccuuggcucu

SEQ ID NO: 12551 - RNA, 19 nt, Artificial Sequence
  Synthetic
ggguuaucuccuuggcucu

SEQ ID NO: 12552 - RNA, 20 nt, Artificial Sequence
  Synthetic
uggguuaucuccuuggcucu

SEQ ID NO: 12553 - RNA, 21 nt, Artificial Sequence
  Synthetic
cuggguuaucuccuuggcucu

SEQ ID NO: 12554 - RNA, 22 nt, Artificial Sequence
  Synthetic
gcuggguuaucuccuuggcucu

SEQ ID NO: 12555 - RNA, 23 nt, Artificial Sequence
  Synthetic
ugcuggguuaucuccuuggcucu

SEQ ID NO: 12556 - RNA, 24 nt, Artificial Sequence
  Synthetic
gugcuggguuaucuccuuggcucu

SEQ ID NO: 12557 - RNA, 18 nt, Artificial Sequence
  Synthetic
ugcagaucucagauuucu

SEQ ID NO: 12558 - RNA, 19 nt, Artificial Sequence
  Synthetic
gugcagaucucagauuucu

SEQ ID NO: 12559 - RNA, 20 nt, Artificial Sequence
  Synthetic
agugcagaucucagauuucu

SEQ ID NO: 12560 - RNA, 21 nt, Artificial Sequence
  Synthetic
aagugcagaucucagauuucu

SEQ ID NO: 12561 - RNA, 22 nt, Artificial Sequence
  Synthetic
aaagugcagaucucagauuucu

SEQ ID NO: 12562 - RNA, 23 nt, Artificial Sequence
  Synthetic
aaaagugcagaucucagauuucu

SEQ ID NO: 12563 - RNA, 24 nt, Artificial Sequence
  Synthetic
caaaagugcagaucucagauuucu

SEQ ID NO: 12564 - RNA, 18 nt, Artificial Sequence
  Synthetic
ccuccccgcucacuaagu

SEQ ID NO: 12565 - RNA, 19 nt, Artificial Sequence
  Synthetic
uccuccccgcucacuaagu

SEQ ID NO: 12566 - RNA, 21 nt, Artificial Sequence
  Synthetic
ucuccuccccgcucacuaagu

SEQ ID NO: 12567 - RNA, 22 nt, Artificial Sequence
  Synthetic
gucuccuccccgcucacuaagu

SEQ ID NO: 12568 - RNA, 23 nt, Artificial Sequence
  Synthetic
ggucuccuccccgcucacuaagu

SEQ ID NO: 12569 - RNA, 24 nt, Artificial Sequence
  Synthetic
aggucuccuccccgcucacuaagu

SEQ ID NO: 12570 - RNA, 18 nt, Artificial Sequence
  Synthetic
gaggggcugaggaggagu

SEQ ID NO: 12571 - RNA, 19 nt, Artificial Sequence
  Synthetic
ggaggggcugaggaggagu

SEQ ID NO: 12572 - RNA, 20 nt, Artificial Sequence
  Synthetic
gggaggggcugaggaggagu

SEQ ID NO: 12573 - RNA, 21 nt, Artificial Sequence
  Synthetic
ggggaggggcugaggaggagu

SEQ ID NO: 12574 - RNA, 22 nt, Artificial Sequence
  Synthetic
gggggaggggcugaggaggagu

SEQ ID NO: 12575 - RNA, 23 nt, Artificial Sequence
  Synthetic
ggggggaggggcugaggaggagu

SEQ ID NO: 12576 - RNA, 24 nt, Artificial Sequence
  Synthetic
cggggggaggggcugaggaggagu

SEQ ID NO: 12577 - RNA, 18 nt, Artificial Sequence
  Synthetic
cagcagaccugcgggagu

SEQ ID NO: 12578 - RNA, 19 nt, Artificial Sequence
  Synthetic
ccagcagaccugcgggagu

SEQ ID NO: 12579 - RNA, 21 nt, Artificial Sequence
  Synthetic
agccagcagaccugcgggagu

SEQ ID NO: 12580 - RNA, 22 nt, Artificial Sequence
  Synthetic
gagccagcagaccugcgggagu

SEQ ID NO: 12581 - RNA, 23 nt, Artificial Sequence
  Synthetic
ggagccagcagaccugcgggagu

SEQ ID NO: 12582 - RNA, 24 nt, Artificial Sequence
  Synthetic
uggagccagcagaccugcgggagu

SEQ ID NO: 12583 - RNA, 18 nt, Artificial Sequence
  Synthetic
gagugaguagaggcaggu

SEQ ID NO: 12584 - RNA, 19 nt, Artificial Sequence
  Synthetic
ugagugaguagaggcaggu

SEQ ID NO: 12585 - RNA, 21 nt, Artificial Sequence
  Synthetic
acugagugaguagaggcaggu

SEQ ID NO: 12586 - RNA, 22 nt, Artificial Sequence
  Synthetic
cacugagugaguagaggcaggu

SEQ ID NO: 12587 - RNA, 23 nt, Artificial Sequence
  Synthetic
gcacugagugaguagaggcaggu

SEQ ID NO: 12588 - RNA, 24 nt, Artificial Sequence
  Synthetic
ggcacugagugaguagaggcaggu

SEQ ID NO: 12589 - RNA, 18 nt, Artificial Sequence
  Synthetic
ggggacaggauggcaggu

SEQ ID NO: 12590 - RNA, 19 nt, Artificial Sequence
  Synthetic
gggggacaggauggcaggu

SEQ ID NO: 12591 - RNA, 20 nt, Artificial Sequence
  Synthetic
ugggggacaggauggcaggu

SEQ ID NO: 12592 - RNA, 21 nt, Artificial Sequence
  Synthetic
cugggggacaggauggcaggu

SEQ ID NO: 12593 - RNA, 22 nt, Artificial Sequence
  Synthetic
gcugggggacaggauggcaggu

SEQ ID NO: 12594 - RNA, 23 nt, Artificial Sequence
  Synthetic
ggcugggggacaggauggcaggu

SEQ ID NO: 12595 - RNA, 24 nt, Artificial Sequence
  Synthetic
aggcugggggacaggauggcaggu

SEQ ID NO: 12596 - RNA, 18 nt, Artificial Sequence
  Synthetic
ugcagggcuccaggaggu

SEQ ID NO: 12597 - RNA, 19 nt, Artificial Sequence
  Synthetic
cugcagggcuccaggaggu

SEQ ID NO: 12598 - RNA, 20 nt, Artificial Sequence
  Synthetic
acugcagggcuccaggaggu

SEQ ID NO: 12599 - RNA, 21 nt, Artificial Sequence
  Synthetic
gacugcagggcuccaggaggu

SEQ ID NO: 12600 - RNA, 22 nt, Artificial Sequence
  Synthetic
ggacugcagggcuccaggaggu

SEQ ID NO: 12601 - RNA, 23 nt, Artificial Sequence
  Synthetic
aggacugcagggcuccaggaggu

SEQ ID NO: 12602 - RNA, 24 nt, Artificial Sequence
  Synthetic
caggacugcagggcuccaggaggu

SEQ ID NO: 12603 - RNA, 18 nt, Artificial Sequence
  Synthetic
aaaucaguuuucugaggu

SEQ ID NO: 12604 - RNA, 19 nt, Artificial Sequence
  Synthetic
uaaaucaguuuucugaggu

SEQ ID NO: 12605 - RNA, 20 nt, Artificial Sequence
  Synthetic
auaaaucaguuuucugaggu

SEQ ID NO: 12606 - RNA, 21 nt, Artificial Sequence
  Synthetic
gauaaaucaguuuucugaggu

SEQ ID NO: 12607 - RNA, 22 nt, Artificial Sequence
  Synthetic
ggauaaaucaguuuucugaggu

SEQ ID NO: 12608 - RNA, 23 nt, Artificial Sequence
  Synthetic
aggauaaaucaguuuucugaggu

SEQ ID NO: 12609 - RNA, 24 nt, Artificial Sequence
  Synthetic
aaggauaaaucaguuuucugaggu

SEQ ID NO: 12610 - RNA, 18 nt, Artificial Sequence
  Synthetic
aaggagagagaggagggu

SEQ ID NO: 12611 - RNA, 19 nt, Artificial Sequence
  Synthetic
caaggagagagaggagggu

SEQ ID NO: 12612 - RNA, 20 nt, Artificial Sequence
  Synthetic
gcaaggagagagaggagggu

SEQ ID NO: 12613 - RNA, 21 nt, Artificial Sequence
  Synthetic
agcaaggagagagaggagggu

SEQ ID NO: 12614 - RNA, 22 nt, Artificial Sequence
  Synthetic
gagcaaggagagagaggagggu

SEQ ID NO: 12615 - RNA, 23 nt, Artificial Sequence
  Synthetic
ugagcaaggagagagaggagggu

SEQ ID NO: 12616 - RNA, 24 nt, Artificial Sequence
  Synthetic
gugagcaaggagagagaggagggu

SEQ ID NO: 12617 - RNA, 18 nt, Artificial Sequence
  Synthetic
ggcugagagggccugggu

SEQ ID NO: 12618 - RNA, 19 nt, Artificial Sequence
  Synthetic
aggcugagagggccugggu

SEQ ID NO: 12619 - RNA, 21 nt, Artificial Sequence
  Synthetic
ccaggcugagagggccugggu

SEQ ID NO: 12620 - RNA, 22 nt, Artificial Sequence
  Synthetic
gccaggcugagagggccugggu

SEQ ID NO: 12621 - RNA, 23 nt, Artificial Sequence
  Synthetic
agccaggcugagagggccugggu

SEQ ID NO: 12622 - RNA, 24 nt, Artificial Sequence
  Synthetic
cagccaggcugagagggccugggu

SEQ ID NO: 12623 - RNA, 18 nt, Artificial Sequence
  Synthetic
cagguggggggcaguggu

SEQ ID NO: 12624 - RNA, 19 nt, Artificial Sequence
  Synthetic
gcagguggggggcaguggu

SEQ ID NO: 12625 - RNA, 21 nt, Artificial Sequence
  Synthetic
aggcagguggggggcaguggu

SEQ ID NO: 12626 - RNA, 22 nt, Artificial Sequence
  Synthetic
gaggcagguggggggcaguggu

SEQ ID NO: 12627 - RNA, 23 nt, Artificial Sequence
  Synthetic
agaggcagguggggggcaguggu

SEQ ID NO: 12628 - RNA, 24 nt, Artificial Sequence
  Synthetic
uagaggcagguggggggcaguggu

SEQ ID NO: 12629 - RNA, 18 nt, Artificial Sequence
  Synthetic
ucauaucaagggcucugu

SEQ ID NO: 12630 - RNA, 19 nt, Artificial Sequence
  Synthetic
uucauaucaagggcucugu

SEQ ID NO: 12631 - RNA, 20 nt, Artificial Sequence
  Synthetic
uuucauaucaagggcucugu

SEQ ID NO: 12632 - RNA, 21 nt, Artificial Sequence
  Synthetic
uuuucauaucaagggcucugu

SEQ ID NO: 12633 - RNA, 22 nt, Artificial Sequence
  Synthetic
guuuucauaucaagggcucugu

SEQ ID NO: 12634 - RNA, 23 nt, Artificial Sequence
  Synthetic
aguuuucauaucaagggcucugu

SEQ ID NO: 12635 - RNA, 24 nt, Artificial Sequence
  Synthetic
uaguuuucauaucaagggcucugu

SEQ ID NO: 12636 - RNA, 18 nt, Artificial Sequence
  Synthetic
uguuugaucucaaagguu

SEQ ID NO: 12637 - RNA, 19 nt, Artificial Sequence
  Synthetic
cuguuugaucucaaagguu

SEQ ID NO: 12638 - RNA, 20 nt, Artificial Sequence
  Synthetic
gcuguuugaucucaaagguu

SEQ ID NO: 12639 - RNA, 21 nt, Artificial Sequence
  Synthetic
ggcuguuugaucucaaagguu

SEQ ID NO: 12640 - RNA, 22 nt, Artificial Sequence
  Synthetic
uggcuguuugaucucaaagguu

SEQ ID NO: 12641 - RNA, 23 nt, Artificial Sequence
  Synthetic
cuggcuguuugaucucaaagguu

SEQ ID NO: 12642 - RNA, 24 nt, Artificial Sequence
  Synthetic
ccuggcuguuugaucucaaagguu

SEQ ID NO: 12643 - RNA, 18 nt, Artificial Sequence
  Synthetic
caaggauaaaucaguuuu

SEQ ID NO: 12644 - RNA, 19 nt, Artificial Sequence
  Synthetic
ccaaggauaaaucaguuuu

SEQ ID NO: 12645 - RNA, 20 nt, Artificial Sequence
  Synthetic
cccaaggauaaaucaguuuu

SEQ ID NO: 12646 - RNA, 21 nt, Artificial Sequence
  Synthetic
ucccaaggauaaaucaguuuu

SEQ ID NO: 12647 - RNA, 22 nt, Artificial Sequence
  Synthetic
uucccaaggauaaaucaguuuu

SEQ ID NO: 12648 - RNA, 23 nt, Artificial Sequence
  Synthetic
cuucccaaggauaaaucaguuuu

SEQ ID NO: 12649 - RNA, 24 nt, Artificial Sequence
  Synthetic
ccuucccaaggauaaaucaguuuu

SEQ ID NO: 12650 - RNA, 18 nt, Artificial Sequence
  Synthetic
gucagagccgggaguuuu

SEQ ID NO: 12651 - RNA, 19 nt, Artificial Sequence
  Synthetic
agucagagccgggaguuuu

SEQ ID NO: 12652 - RNA, 20 nt, Artificial Sequence
  Synthetic
gagucagagccgggaguuuu

SEQ ID NO: 12653 - RNA, 21 nt, Artificial Sequence
  Synthetic
ggagucagagccgggaguuuu

SEQ ID NO: 12654 - RNA, 22 nt, Artificial Sequence
  Synthetic
aggagucagagccgggaguuuu

SEQ ID NO: 12655 - RNA, 23 nt, Artificial Sequence
  Synthetic
gaggagucagagccgggaguuuu

SEQ ID NO: 12656 - RNA, 24 nt, Artificial Sequence
  Synthetic
ggaggagucagagccgggaguuuu

SEQ ID NO: 12657 - RNA, 18 nt, Artificial Sequence
  Synthetic
gcagccaacaguguaaaa

SEQ ID NO: 12658 - RNA, 19 nt, Artificial Sequence
  Synthetic
ggcagccaacaguguaaaa

SEQ ID NO: 12659 - RNA, 20 nt, Artificial Sequence
  Synthetic
uggcagccaacaguguaaaa

SEQ ID NO: 12660 - RNA, 21 nt, Artificial Sequence
  Synthetic
cuggcagccaacaguguaaaa

SEQ ID NO: 12661 - RNA, 22 nt, Artificial Sequence
  Synthetic
ccuggcagccaacaguguaaaa

SEQ ID NO: 12662 - RNA, 23 nt, Artificial Sequence
  Synthetic
gccuggcagccaacaguguaaaa

SEQ ID NO: 12663 - RNA, 24 nt, Artificial Sequence
  Synthetic
ggccuggcagccaacaguguaaaa

SEQ ID NO: 12664 - RNA, 18 nt, Artificial Sequence
  Synthetic
ucuuuuaaaguguacaaa

SEQ ID NO: 12665 - RNA, 19 nt, Artificial Sequence
  Synthetic
aucuuuuaaaguguacaaa

SEQ ID NO: 12666 - RNA, 20 nt, Artificial Sequence
  Synthetic
aaucuuuuaaaguguacaaa

SEQ ID NO: 12667 - RNA, 21 nt, Artificial Sequence
  Synthetic
caaucuuuuaaaguguacaaa

SEQ ID NO: 12668 - RNA, 22 nt, Artificial Sequence
  Synthetic
acaaucuuuuaaaguguacaaa

SEQ ID NO: 12669 - RNA, 23 nt, Artificial Sequence
  Synthetic
gacaaucuuuuaaaguguacaaa

SEQ ID NO: 12670 - RNA, 24 nt, Artificial Sequence
  Synthetic
agacaaucuuuuaaaguguacaaa

SEQ ID NO: 12671 - RNA, 18 nt, Artificial Sequence
  Synthetic
gagcaggagagacccaaa

SEQ ID NO: 12672 - RNA, 19 nt, Artificial Sequence
  Synthetic
agagcaggagagacccaaa

SEQ ID NO: 12673 - RNA, 20 nt, Artificial Sequence
  Synthetic
gagagcaggagagacccaaa

SEQ ID NO: 12674 - RNA, 21 nt, Artificial Sequence
  Synthetic
ggagagcaggagagacccaaa

SEQ ID NO: 12675 - RNA, 22 nt, Artificial Sequence
  Synthetic
aggagagcaggagagacccaaa

SEQ ID NO: 12676 - RNA, 23 nt, Artificial Sequence
  Synthetic
gaggagagcaggagagacccaaa

SEQ ID NO: 12677 - RNA, 24 nt, Artificial Sequence
  Synthetic
agaggagagcaggagagacccaaa

SEQ ID NO: 12678 - RNA, 18 nt, Artificial Sequence
  Synthetic
caggcaugagcuggcaaa

SEQ ID NO: 12679 - RNA, 19 nt, Artificial Sequence
  Synthetic
ucaggcaugagcuggcaaa

SEQ ID NO: 12680 - RNA, 20 nt, Artificial Sequence
  Synthetic
uucaggcaugagcuggcaaa

SEQ ID NO: 12681 - RNA, 21 nt, Artificial Sequence
  Synthetic
uuucaggcaugagcuggcaaa

SEQ ID NO: 12682 - RNA, 22 nt, Artificial Sequence
  Synthetic
auuucaggcaugagcuggcaaa

SEQ ID NO: 12683 - RNA, 23 nt, Artificial Sequence
  Synthetic
gauuucaggcaugagcuggcaaa

SEQ ID NO: 12684 - RNA, 24 nt, Artificial Sequence
  Synthetic
ggauuucaggcaugagcuggcaaa

SEQ ID NO: 12685 - RNA, 18 nt, Artificial Sequence
  Synthetic
agggggcagagacagaaa

SEQ ID NO: 12686 - RNA, 19 nt, Artificial Sequence
  Synthetic
aagggggcagagacagaaa

SEQ ID NO: 12687 - RNA, 21 nt, Artificial Sequence
  Synthetic
ggaagggggcagagacagaaa

SEQ ID NO: 12688 - RNA, 22 nt, Artificial Sequence
  Synthetic
aggaagggggcagagacagaaa

SEQ ID NO: 12689 - RNA, 23 nt, Artificial Sequence
  Synthetic
aaggaagggggcagagacagaaa

SEQ ID NO: 12690 - RNA, 24 nt, Artificial Sequence
  Synthetic
aaaggaagggggcagagacagaaa

SEQ ID NO: 12691 - RNA, 18 nt, Artificial Sequence
  Synthetic
gaggaggcaggccagaaa

SEQ ID NO: 12692 - RNA, 19 nt, Artificial Sequence
  Synthetic
agaggaggcaggccagaaa

SEQ ID NO: 12693 - RNA, 20 nt, Artificial Sequence
  Synthetic
gagaggaggcaggccagaaa

SEQ ID NO: 12694 - RNA, 21 nt, Artificial Sequence
  Synthetic
agagaggaggcaggccagaaa

SEQ ID NO: 12695 - RNA, 22 nt, Artificial Sequence
  Synthetic
gagagaggaggcaggccagaaa

SEQ ID NO: 12696 - RNA, 23 nt, Artificial Sequence
  Synthetic
agagagaggaggcaggccagaaa

SEQ ID NO: 12697 - RNA, 24 nt, Artificial Sequence
  Synthetic
uagagagaggaggcaggccagaaa

SEQ ID NO: 12698 - RNA, 18 nt, Artificial Sequence
  Synthetic
gagagacccaaagagaaa

SEQ ID NO: 12699 - RNA, 19 nt, Artificial Sequence
  Synthetic
ggagagacccaaagagaaa

SEQ ID NO: 12700 - RNA, 20 nt, Artificial Sequence
  Synthetic
aggagagacccaaagagaaa

SEQ ID NO: 12701 - RNA, 21 nt, Artificial Sequence
  Synthetic
caggagagacccaaagagaaa

SEQ ID NO: 12702 - RNA, 22 nt, Artificial Sequence
  Synthetic
gcaggagagacccaaagagaaa

SEQ ID NO: 12703 - RNA, 23 nt, Artificial Sequence
  Synthetic
agcaggagagacccaaagagaaa

SEQ ID NO: 12704 - RNA, 24 nt, Artificial Sequence
  Synthetic
gagcaggagagacccaaagagaaa

SEQ ID NO: 12705 - RNA, 18 nt, Artificial Sequence
  Synthetic
cgaggaaucagcaggaaa

SEQ ID NO: 12706 - RNA, 19 nt, Artificial Sequence
  Synthetic
gcgaggaaucagcaggaaa

SEQ ID NO: 12707 - RNA, 20 nt, Artificial Sequence
  Synthetic
ggcgaggaaucagcaggaaa

SEQ ID NO: 12708 - RNA, 21 nt, Artificial Sequence
  Synthetic
uggcgaggaaucagcaggaaa

SEQ ID NO: 12709 - RNA, 22 nt, Artificial Sequence
  Synthetic
guggcgaggaaucagcaggaaa

SEQ ID NO: 12710 - RNA, 23 nt, Artificial Sequence
  Synthetic
gguggcgaggaaucagcaggaaa

SEQ ID NO: 12711 - RNA, 24 nt, Artificial Sequence
  Synthetic
ggguggcgaggaaucagcaggaaa

SEQ ID NO: 12712 - RNA, 18 nt, Artificial Sequence
  Synthetic
cuggaggaagaagaccaa

SEQ ID NO: 12713 - RNA, 19 nt, Artificial Sequence
  Synthetic
ccuggaggaagaagaccaa

SEQ ID NO: 12714 - RNA, 21 nt, Artificial Sequence
  Synthetic
auccuggaggaagaagaccaa

SEQ ID NO: 12715 - RNA, 22 nt, Artificial Sequence
  Synthetic
gauccuggaggaagaagaccaa

SEQ ID NO: 12716 - RNA, 23 nt, Artificial Sequence
  Synthetic
agauccuggaggaagaagaccaa

SEQ ID NO: 12717 - RNA, 24 nt, Artificial Sequence
  Synthetic
cagauccuggaggaagaagaccaa

SEQ ID NO: 12718 - RNA, 18 nt, Artificial Sequence
  Synthetic
uccagcugucccuuccaa

SEQ ID NO: 12719 - RNA, 19 nt, Artificial Sequence
  Synthetic
auccagcugucccuuccaa

SEQ ID NO: 12720 - RNA, 21 nt, Artificial Sequence
  Synthetic
aaauccagcugucccuuccaa

SEQ ID NO: 12721 - RNA, 22 nt, Artificial Sequence
  Synthetic
aaaauccagcugucccuuccaa

SEQ ID NO: 12722 - RNA, 23 nt, Artificial Sequence
  Synthetic
aaaaauccagcugucccuuccaa

SEQ ID NO: 12723 - RNA, 24 nt, Artificial Sequence
  Synthetic
gaaaaauccagcugucccuuccaa

SEQ ID NO: 12724 - RNA, 18 nt, Artificial Sequence
  Synthetic
cgcaagagacugccgcaa

SEQ ID NO: 12725 - RNA, 19 nt, Artificial Sequence
  Synthetic
ucgcaagagacugccgcaa

SEQ ID NO: 12726 - RNA, 20 nt, Artificial Sequence
  Synthetic
gucgcaagagacugccgcaa

SEQ ID NO: 12727 - RNA, 21 nt, Artificial Sequence
  Synthetic
agucgcaagagacugccgcaa

SEQ ID NO: 12728 - RNA, 22 nt, Artificial Sequence
  Synthetic
aagucgcaagagacugccgcaa

SEQ ID NO: 12729 - RNA, 23 nt, Artificial Sequence
  Synthetic
gaagucgcaagagacugccgcaa

SEQ ID NO: 12730 - RNA, 24 nt, Artificial Sequence
  Synthetic
agaagucgcaagagacugccgcaa

SEQ ID NO: 12731 - RNA, 18 nt, Artificial Sequence
  Synthetic
ugagagggggcaaggcaa

SEQ ID NO: 12732 - RNA, 19 nt, Artificial Sequence
  Synthetic
gugagagggggcaaggcaa

SEQ ID NO: 12733 - RNA, 21 nt, Artificial Sequence
  Synthetic
gagugagagggggcaaggcaa

SEQ ID NO: 12734 - RNA, 22 nt, Artificial Sequence
  Synthetic
agagugagagggggcaaggcaa

SEQ ID NO: 12735 - RNA, 23 nt, Artificial Sequence
  Synthetic
uagagugagagggggcaaggcaa

SEQ ID NO: 12736 - RNA, 24 nt, Artificial Sequence
  Synthetic
cuagagugagagggggcaaggcaa

SEQ ID NO: 12737 - RNA, 18 nt, Artificial Sequence
  Synthetic
uguaaggaccuggcucaa

SEQ ID NO: 12738 - RNA, 19 nt, Artificial Sequence
  Synthetic
auguaaggaccuggcucaa

SEQ ID NO: 12739 - RNA, 21 nt, Artificial Sequence
  Synthetic
caauguaaggaccuggcucaa

SEQ ID NO: 12740 - RNA, 22 nt, Artificial Sequence
  Synthetic
ccaauguaaggaccuggcucaa

SEQ ID NO: 12741 - RNA, 23 nt, Artificial Sequence
  Synthetic
cccaauguaaggaccuggcucaa

SEQ ID NO: 12742 - RNA, 24 nt, Artificial Sequence
  Synthetic
gcccaauguaaggaccuggcucaa

SEQ ID NO: 12743 - RNA, 18 nt, Artificial Sequence
  Synthetic
uuuggcugccagauucaa

SEQ ID NO: 12744 - RNA, 19 nt, Artificial Sequence
  Synthetic
guuuggcugccagauucaa

SEQ ID NO: 12745 - RNA, 20 nt, Artificial Sequence
  Synthetic
gguuuggcugccagauucaa

SEQ ID NO: 12746 - RNA, 21 nt, Artificial Sequence
  Synthetic
agguuuggcugccagauucaa

SEQ ID NO: 12747 - RNA, 22 nt, Artificial Sequence
  Synthetic
gagguuuggcugccagauucaa

SEQ ID NO: 12748 - RNA, 23 nt, Artificial Sequence
  Synthetic
agagguuuggcugccagauucaa

SEQ ID NO: 12749 - RNA, 24 nt, Artificial Sequence
  Synthetic
gagagguuuggcugccagauucaa

SEQ ID NO: 12750 - RNA, 18 nt, Artificial Sequence
  Synthetic
aagggggcagagacagaa

SEQ ID NO: 12751 - RNA, 19 nt, Artificial Sequence
  Synthetic
gaagggggcagagacagaa

SEQ ID NO: 12752 - RNA, 21 nt, Artificial Sequence
  Synthetic
aggaagggggcagagacagaa

SEQ ID NO: 12753 - RNA, 22 nt, Artificial Sequence
  Synthetic
aaggaagggggcagagacagaa

SEQ ID NO: 12754 - RNA, 23 nt, Artificial Sequence
  Synthetic
aaaggaagggggcagagacagaa

SEQ ID NO: 12755 - RNA, 24 nt, Artificial Sequence
  Synthetic
caaaggaagggggcagagacagaa

SEQ ID NO: 12756 - RNA, 18 nt, Artificial Sequence
  Synthetic
ggaagaagaccaaaggaa

SEQ ID NO: 12757 - RNA, 19 nt, Artificial Sequence
  Synthetic
aggaagaagaccaaaggaa

SEQ ID NO: 12758 - RNA, 21 nt, Artificial Sequence
  Synthetic
ggaggaagaagaccaaaggaa

SEQ ID NO: 12759 - RNA, 22 nt, Artificial Sequence
  Synthetic
uggaggaagaagaccaaaggaa

SEQ ID NO: 12760 - RNA, 23 nt, Artificial Sequence
  Synthetic
cuggaggaagaagaccaaaggaa

SEQ ID NO: 12761 - RNA, 24 nt, Artificial Sequence
  Synthetic
ccuggaggaagaagaccaaaggaa

SEQ ID NO: 12762 - RNA, 18 nt, Artificial Sequence
  Synthetic
gcaagggggggagaggaa

SEQ ID NO: 12763 - RNA, 19 nt, Artificial Sequence
  Synthetic
ggcaagggggggagaggaa

SEQ ID NO: 12764 - RNA, 20 nt, Artificial Sequence
  Synthetic
aggcaagggggggagaggaa

SEQ ID NO: 12765 - RNA, 21 nt, Artificial Sequence
  Synthetic
aaggcaagggggggagaggaa

SEQ ID NO: 12766 - RNA, 22 nt, Artificial Sequence
  Synthetic
caaggcaagggggggagaggaa

SEQ ID NO: 12767 - RNA, 23 nt, Artificial Sequence
  Synthetic
gcaaggcaagggggggagaggaa

SEQ ID NO: 12768 - RNA, 24 nt, Artificial Sequence
  Synthetic
ggcaaggcaagggggggagaggaa

SEQ ID NO: 12769 - RNA, 18 nt, Artificial Sequence
  Synthetic
ugccagauucaacuggaa

SEQ ID NO: 12770 - RNA, 19 nt, Artificial Sequence
  Synthetic
cugccagauucaacuggaa

SEQ ID NO: 12771 - RNA, 21 nt, Artificial Sequence
  Synthetic
ggcugccagauucaacuggaa

SEQ ID NO: 12772 - RNA, 22 nt, Artificial Sequence
  Synthetic
uggcugccagauucaacuggaa

SEQ ID NO: 12773 - RNA, 23 nt, Artificial Sequence
  Synthetic
uuggcugccagauucaacuggaa

SEQ ID NO: 12774 - RNA, 24 nt, Artificial Sequence
  Synthetic
uuuggcugccagauucaacuggaa

SEQ ID NO: 12775 - RNA, 18 nt, Artificial Sequence
  Synthetic
cgcccugcucaccuuuaa

SEQ ID NO: 12776 - RNA, 19 nt, Artificial Sequence
  Synthetic
ccgcccugcucaccuuuaa

SEQ ID NO: 12777 - RNA, 20 nt, Artificial Sequence
  Synthetic
cccgcccugcucaccuuuaa

SEQ ID NO: 12778 - RNA, 21 nt, Artificial Sequence
  Synthetic
ccccgcccugcucaccuuuaa

SEQ ID NO: 12779 - RNA, 22 nt, Artificial Sequence
  Synthetic
cccccgcccugcucaccuuuaa

SEQ ID NO: 12780 - RNA, 23 nt, Artificial Sequence
  Synthetic
ccccccgcccugcucaccuuuaa

SEQ ID NO: 12781 - RNA, 24 nt, Artificial Sequence
  Synthetic
uccccccgcccugcucaccuuuaa

SEQ ID NO: 12782 - RNA, 18 nt, Artificial Sequence
  Synthetic
aguuucuucauuaggaca

SEQ ID NO: 12783 - RNA, 19 nt, Artificial Sequence
  Synthetic
caguuucuucauuaggaca

SEQ ID NO: 12784 - RNA, 20 nt, Artificial Sequence
  Synthetic
ucaguuucuucauuaggaca

SEQ ID NO: 12785 - RNA, 21 nt, Artificial Sequence
  Synthetic
gucaguuucuucauuaggaca

SEQ ID NO: 12786 - RNA, 22 nt, Artificial Sequence
  Synthetic
ggucaguuucuucauuaggaca

SEQ ID NO: 12787 - RNA, 23 nt, Artificial Sequence
  Synthetic
gggucaguuucuucauuaggaca

SEQ ID NO: 12788 - RNA, 24 nt, Artificial Sequence
  Synthetic
agggucaguuucuucauuaggaca

SEQ ID NO: 12789 - RNA, 18 nt, Artificial Sequence
  Synthetic
ccuggaggaagaagacca

SEQ ID NO: 12790 - RNA, 19 nt, Artificial Sequence
  Synthetic
uccuggaggaagaagacca

SEQ ID NO: 12791 - RNA, 20 nt, Artificial Sequence
  Synthetic
auccuggaggaagaagacca

SEQ ID NO: 12792 - RNA, 21 nt, Artificial Sequence
  Synthetic
gauccuggaggaagaagacca

SEQ ID NO: 12793 - RNA, 22 nt, Artificial Sequence
  Synthetic
agauccuggaggaagaagacca

SEQ ID NO: 12794 - RNA, 23 nt, Artificial Sequence
  Synthetic
cagauccuggaggaagaagacca

SEQ ID NO: 12795 - RNA, 24 nt, Artificial Sequence
  Synthetic
acagauccuggaggaagaagacca

SEQ ID NO: 12796 - RNA, 18 nt, Artificial Sequence
  Synthetic
gagauaacccagcaccca

SEQ ID NO: 12797 - RNA, 19 nt, Artificial Sequence
  Synthetic
ggagauaacccagcaccca

SEQ ID NO: 12798 - RNA, 20 nt, Artificial Sequence
  Synthetic
aggagauaacccagcaccca

SEQ ID NO: 12799 - RNA, 21 nt, Artificial Sequence
  Synthetic
aaggagauaacccagcaccca

SEQ ID NO: 12800 - RNA, 22 nt, Artificial Sequence
  Synthetic
caaggagauaacccagcaccca

SEQ ID NO: 12801 - RNA, 23 nt, Artificial Sequence
  Synthetic
ccaaggagauaacccagcaccca

SEQ ID NO: 12802 - RNA, 24 nt, Artificial Sequence
  Synthetic
gccaaggagauaacccagcaccca

SEQ ID NO: 12803 - RNA, 18 nt, Artificial Sequence
  Synthetic
gagagcaggagagaccca

SEQ ID NO: 12804 - RNA, 19 nt, Artificial Sequence
  Synthetic
ggagagcaggagagaccca

SEQ ID NO: 12805 - RNA, 20 nt, Artificial Sequence
  Synthetic
aggagagcaggagagaccca

SEQ ID NO: 12806 - RNA, 21 nt, Artificial Sequence
  Synthetic
gaggagagcaggagagaccca

SEQ ID NO: 12807 - RNA, 22 nt, Artificial Sequence
  Synthetic
agaggagagcaggagagaccca

SEQ ID NO: 12808 - RNA, 23 nt, Artificial Sequence
  Synthetic
aagaggagagcaggagagaccca

SEQ ID NO: 12809 - RNA, 24 nt, Artificial Sequence
  Synthetic
aaagaggagagcaggagagaccca

SEQ ID NO: 12810 - RNA, 18 nt, Artificial Sequence
  Synthetic
gcuaaguagauagcccca

SEQ ID NO: 12811 - RNA, 19 nt, Artificial Sequence
  Synthetic
cgcuaaguagauagcccca

SEQ ID NO: 12812 - RNA, 20 nt, Artificial Sequence
  Synthetic
gcgcuaaguagauagcccca

SEQ ID NO: 12813 - RNA, 21 nt, Artificial Sequence
  Synthetic
agcgcuaaguagauagcccca

SEQ ID NO: 12814 - RNA, 22 nt, Artificial Sequence
  Synthetic
aagcgcuaaguagauagcccca

SEQ ID NO: 12815 - RNA, 23 nt, Artificial Sequence
  Synthetic
aaagcgcuaaguagauagcccca

SEQ ID NO: 12816 - RNA, 24 nt, Artificial Sequence
  Synthetic
aaaagcgcuaaguagauagcccca

SEQ ID NO: 12817 - RNA, 18 nt, Artificial Sequence
  Synthetic
gaccuuuucacagagcca

SEQ ID NO: 12818 - RNA, 19 nt, Artificial Sequence
  Synthetic
agaccuuuucacagagcca

SEQ ID NO: 12819 - RNA, 21 nt, Artificial Sequence
  Synthetic
agagaccuuuucacagagcca

SEQ ID NO: 12820 - RNA, 22 nt, Artificial Sequence
  Synthetic
cagagaccuuuucacagagcca

SEQ ID NO: 12821 - RNA, 23 nt, Artificial Sequence
  Synthetic
gcagagaccuuuucacagagcca

SEQ ID NO: 12822 - RNA, 24 nt, Artificial Sequence
  Synthetic
ugcagagaccuuuucacagagcca

SEQ ID NO: 12823 - RNA, 18 nt, Artificial Sequence
  Synthetic
uccaucccuggccggcca

SEQ ID NO: 12824 - RNA, 19 nt, Artificial Sequence
  Synthetic
uuccaucccuggccggcca

SEQ ID NO: 12825 - RNA, 20 nt, Artificial Sequence
  Synthetic
cuuccaucccuggccggcca

SEQ ID NO: 12826 - RNA, 21 nt, Artificial Sequence
  Synthetic
gcuuccaucccuggccggcca

SEQ ID NO: 12827 - RNA, 22 nt, Artificial Sequence
  Synthetic
cgcuuccaucccuggccggcca

SEQ ID NO: 12828 - RNA, 23 nt, Artificial Sequence
  Synthetic
ucgcuuccaucccuggccggcca

SEQ ID NO: 12829 - RNA, 24 nt, Artificial Sequence
  Synthetic
gucgcuuccaucccuggccggcca

SEQ ID NO: 12830 - RNA, 18 nt, Artificial Sequence
  Synthetic
auccagcugucccuucca

SEQ ID NO: 12831 - RNA, 19 nt, Artificial Sequence
  Synthetic
aauccagcugucccuucca

SEQ ID NO: 12832 - RNA, 21 nt, Artificial Sequence
  Synthetic
aaaauccagcugucccuucca

SEQ ID NO: 12833 - RNA, 22 nt, Artificial Sequence
  Synthetic
aaaaauccagcugucccuucca

SEQ ID NO: 12834 - RNA, 23 nt, Artificial Sequence
  Synthetic
gaaaaauccagcugucccuucca

SEQ ID NO: 12835 - RNA, 24 nt, Artificial Sequence
  Synthetic
agaaaaauccagcugucccuucca

SEQ ID NO: 12836 - RNA, 18 nt, Artificial Sequence
  Synthetic
ggcccuaucagggaagca

SEQ ID NO: 12837 - RNA, 19 nt, Artificial Sequence
  Synthetic
uggcccuaucagggaagca

SEQ ID NO: 12838 - RNA, 20 nt, Artificial Sequence
  Synthetic
guggcccuaucagggaagca

SEQ ID NO: 12839 - RNA, 21 nt, Artificial Sequence
  Synthetic
gguggcccuaucagggaagca

SEQ ID NO: 12840 - RNA, 22 nt, Artificial Sequence
  Synthetic
agguggcccuaucagggaagca

SEQ ID NO: 12841 - RNA, 23 nt, Artificial Sequence
  Synthetic
aagguggcccuaucagggaagca

SEQ ID NO: 12842 - RNA, 24 nt, Artificial Sequence
  Synthetic
aaagguggcccuaucagggaagca

SEQ ID NO: 12843 - RNA, 18 nt, Artificial Sequence
  Synthetic
uggcaaauagaaaaggca

SEQ ID NO: 12844 - RNA, 19 nt, Artificial Sequence
  Synthetic
cuggcaaauagaaaaggca

SEQ ID NO: 12845 - RNA, 21 nt, Artificial Sequence
  Synthetic
agcuggcaaauagaaaaggca

SEQ ID NO: 12846 - RNA, 22 nt, Artificial Sequence
  Synthetic
gagcuggcaaauagaaaaggca

SEQ ID NO: 12847 - RNA, 23 nt, Artificial Sequence
  Synthetic
ugagcuggcaaauagaaaaggca

SEQ ID NO: 12848 - RNA, 24 nt, Artificial Sequence
  Synthetic
augagcuggcaaauagaaaaggca

SEQ ID NO: 12849 - RNA, 18 nt, Artificial Sequence
  Synthetic
gugagagggggcaaggca

SEQ ID NO: 12850 - RNA, 19 nt, Artificial Sequence
  Synthetic
agugagagggggcaaggca

SEQ ID NO: 12851 - RNA, 21 nt, Artificial Sequence
  Synthetic
agagugagagggggcaaggca

SEQ ID NO: 12852 - RNA, 22 nt, Artificial Sequence
  Synthetic
uagagugagagggggcaaggca

SEQ ID NO: 12853 - RNA, 23 nt, Artificial Sequence
  Synthetic
cuagagugagagggggcaaggca

SEQ ID NO: 12854 - RNA, 24 nt, Artificial Sequence
  Synthetic
ccuagagugagagggggcaaggca

SEQ ID NO: 12855 - RNA, 18 nt, Artificial Sequence
  Synthetic
ucugggauauguggggca

SEQ ID NO: 12856 - RNA, 19 nt, Artificial Sequence
  Synthetic
cucugggauauguggggca

SEQ ID NO: 12857 - RNA, 20 nt, Artificial Sequence
  Synthetic
ucucugggauauguggggca

SEQ ID NO: 12858 - RNA, 21 nt, Artificial Sequence
  Synthetic
gucucugggauauguggggca

SEQ ID NO: 12859 - RNA, 22 nt, Artificial Sequence
  Synthetic
ggucucugggauauguggggca

SEQ ID NO: 12860 - RNA, 23 nt, Artificial Sequence
  Synthetic
gggucucugggauauguggggca

SEQ ID NO: 12861 - RNA, 24 nt, Artificial Sequence
  Synthetic
ggggucucugggauauguggggca

SEQ ID NO: 12862 - RNA, 18 nt, Artificial Sequence
  Synthetic
cuuccugagucuccugca

SEQ ID NO: 12863 - RNA, 19 nt, Artificial Sequence
  Synthetic
gcuuccugagucuccugca

SEQ ID NO: 12864 - RNA, 20 nt, Artificial Sequence
  Synthetic
ggcuuccugagucuccugca

SEQ ID NO: 12865 - RNA, 21 nt, Artificial Sequence
  Synthetic
aggcuuccugagucuccugca

SEQ ID NO: 12866 - RNA, 22 nt, Artificial Sequence
  Synthetic
aaggcuuccugagucuccugca

SEQ ID NO: 12867 - RNA, 23 nt, Artificial Sequence
  Synthetic
gaaggcuuccugagucuccugca

SEQ ID NO: 12868 - RNA, 24 nt, Artificial Sequence
  Synthetic
ggaaggcuuccugagucuccugca

SEQ ID NO: 12869 - RNA, 18 nt, Artificial Sequence
  Synthetic
gcugagcaccuuauugca

SEQ ID NO: 12870 - RNA, 19 nt, Artificial Sequence
  Synthetic
ugcugagcaccuuauugca

SEQ ID NO: 12871 - RNA, 21 nt, Artificial Sequence
  Synthetic
ggugcugagcaccuuauugca

SEQ ID NO: 12872 - RNA, 22 nt, Artificial Sequence
  Synthetic
gggugcugagcaccuuauugca

SEQ ID NO: 12873 - RNA, 23 nt, Artificial Sequence
  Synthetic
agggugcugagcaccuuauugca

SEQ ID NO: 12874 - RNA, 24 nt, Artificial Sequence
  Synthetic
cagggugcugagcaccuuauugca

SEQ ID NO: 12875 - RNA, 18 nt, Artificial Sequence
  Synthetic
cgaaagguggcccuauca

SEQ ID NO: 12876 - RNA, 19 nt, Artificial Sequence
  Synthetic
ucgaaagguggcccuauca

SEQ ID NO: 12877 - RNA, 21 nt, Artificial Sequence
  Synthetic
acucgaaagguggcccuauca

SEQ ID NO: 12878 - RNA, 22 nt, Artificial Sequence
  Synthetic
aacucgaaagguggcccuauca

SEQ ID NO: 12879 - RNA, 23 nt, Artificial Sequence
  Synthetic
aaacucgaaagguggcccuauca

SEQ ID NO: 12880 - RNA, 24 nt, Artificial Sequence
  Synthetic
aaaacucgaaagguggcccuauca

SEQ ID NO: 12881 - RNA, 18 nt, Artificial Sequence
  Synthetic
auguaaggaccuggcuca

SEQ ID NO: 12882 - RNA, 19 nt, Artificial Sequence
  Synthetic
aauguaaggaccuggcuca

SEQ ID NO: 12883 - RNA, 21 nt, Artificial Sequence
  Synthetic
ccaauguaaggaccuggcuca

SEQ ID NO: 12884 - RNA, 22 nt, Artificial Sequence
  Synthetic
cccaauguaaggaccuggcuca

SEQ ID NO: 12885 - RNA, 23 nt, Artificial Sequence
  Synthetic
gcccaauguaaggaccuggcuca

SEQ ID NO: 12886 - RNA, 24 nt, Artificial Sequence
  Synthetic
ugcccaauguaaggaccuggcuca

SEQ ID NO: 12887 - RNA, 18 nt, Artificial Sequence
  Synthetic
gcauugcaauucuucuca

SEQ ID NO: 12888 - RNA, 19 nt, Artificial Sequence
  Synthetic
ggcauugcaauucuucuca

SEQ ID NO: 12889 - RNA, 20 nt, Artificial Sequence
  Synthetic
aggcauugcaauucuucuca

SEQ ID NO: 12890 - RNA, 21 nt, Artificial Sequence
  Synthetic
caggcauugcaauucuucuca

SEQ ID NO: 12891 - RNA, 22 nt, Artificial Sequence
  Synthetic
ccaggcauugcaauucuucuca

SEQ ID NO: 12892 - RNA, 23 nt, Artificial Sequence
  Synthetic
accaggcauugcaauucuucuca

SEQ ID NO: 12893 - RNA, 24 nt, Artificial Sequence
  Synthetic
gaccaggcauugcaauucuucuca

SEQ ID NO: 12894 - RNA, 18 nt, Artificial Sequence
  Synthetic
agugcagagaccuuuuca

SEQ ID NO: 12895 - RNA, 19 nt, Artificial Sequence
  Synthetic
cagugcagagaccuuuuca

SEQ ID NO: 12896 - RNA, 20 nt, Artificial Sequence
  Synthetic
acagugcagagaccuuuuca

SEQ ID NO: 12897 - RNA, 21 nt, Artificial Sequence
  Synthetic
gacagugcagagaccuuuuca

SEQ ID NO: 12898 - RNA, 22 nt, Artificial Sequence
  Synthetic
ggacagugcagagaccuuuuca

SEQ ID NO: 12899 - RNA, 23 nt, Artificial Sequence
  Synthetic
gggacagugcagagaccuuuuca

SEQ ID NO: 12900 - RNA, 24 nt, Artificial Sequence
  Synthetic
ggggacagugcagagaccuuuuca

SEQ ID NO: 12901 - RNA, 18 nt, Artificial Sequence
  Synthetic
caagagacugccgcaaga

SEQ ID NO: 12902 - RNA, 19 nt, Artificial Sequence
  Synthetic
gcaagagacugccgcaaga

SEQ ID NO: 12903 - RNA, 20 nt, Artificial Sequence
  Synthetic
cgcaagagacugccgcaaga

SEQ ID NO: 12904 - RNA, 21 nt, Artificial Sequence
  Synthetic
ucgcaagagacugccgcaaga

SEQ ID NO: 12905 - RNA, 22 nt, Artificial Sequence
  Synthetic
gucgcaagagacugccgcaaga

SEQ ID NO: 12906 - RNA, 23 nt, Artificial Sequence
  Synthetic
agucgcaagagacugccgcaaga

SEQ ID NO: 12907 - RNA, 24 nt, Artificial Sequence
  Synthetic
aagucgcaagagacugccgcaaga

SEQ ID NO: 12908 - RNA, 18 nt, Artificial Sequence
  Synthetic
gaagggggcagagacaga

SEQ ID NO: 12909 - RNA, 19 nt, Artificial Sequence
  Synthetic
ggaagggggcagagacaga

SEQ ID NO: 12910 - RNA, 20 nt, Artificial Sequence
  Synthetic
aggaagggggcagagacaga

SEQ ID NO: 12911 - RNA, 21 nt, Artificial Sequence
  Synthetic
aaggaagggggcagagacaga

SEQ ID NO: 12912 - RNA, 22 nt, Artificial Sequence
  Synthetic
aaaggaagggggcagagacaga

SEQ ID NO: 12913 - RNA, 23 nt, Artificial Sequence
  Synthetic
caaaggaagggggcagagacaga

SEQ ID NO: 12914 - RNA, 24 nt, Artificial Sequence
  Synthetic
ccaaaggaagggggcagagacaga

SEQ ID NO: 12915 - RNA, 18 nt, Artificial Sequence
  Synthetic
gagaggaggcaggccaga

SEQ ID NO: 12916 - RNA, 19 nt, Artificial Sequence
  Synthetic
agagaggaggcaggccaga

SEQ ID NO: 12917 - RNA, 20 nt, Artificial Sequence
  Synthetic
gagagaggaggcaggccaga

SEQ ID NO: 12918 - RNA, 21 nt, Artificial Sequence
  Synthetic
agagagaggaggcaggccaga

SEQ ID NO: 12919 - RNA, 22 nt, Artificial Sequence
  Synthetic
uagagagaggaggcaggccaga

SEQ ID NO: 12920 - RNA, 23 nt, Artificial Sequence
  Synthetic
uuagagagaggaggcaggccaga

SEQ ID NO: 12921 - RNA, 24 nt, Artificial Sequence
  Synthetic
auuagagagaggaggcaggccaga

SEQ ID NO: 12922 - RNA, 18 nt, Artificial Sequence
  Synthetic
agagaaacagaaggcaga

SEQ ID NO: 12923 - RNA, 19 nt, Artificial Sequence
  Synthetic
aagagaaacagaaggcaga

SEQ ID NO: 12924 - RNA, 20 nt, Artificial Sequence
  Synthetic
aaagagaaacagaaggcaga

SEQ ID NO: 12925 - RNA, 21 nt, Artificial Sequence
  Synthetic
caaagagaaacagaaggcaga

SEQ ID NO: 12926 - RNA, 22 nt, Artificial Sequence
  Synthetic
ccaaagagaaacagaaggcaga

SEQ ID NO: 12927 - RNA, 23 nt, Artificial Sequence
  Synthetic
cccaaagagaaacagaaggcaga

SEQ ID NO: 12928 - RNA, 24 nt, Artificial Sequence
  Synthetic
acccaaagagaaacagaaggcaga

SEQ ID NO: 12929 - RNA, 18 nt, Artificial Sequence
  Synthetic
aaaggaagggggcagaga

SEQ ID NO: 12930 - RNA, 19 nt, Artificial Sequence
  Synthetic
caaaggaagggggcagaga

SEQ ID NO: 12931 - RNA, 20 nt, Artificial Sequence
  Synthetic
ccaaaggaagggggcagaga

SEQ ID NO: 12932 - RNA, 21 nt, Artificial Sequence
  Synthetic
accaaaggaagggggcagaga

SEQ ID NO: 12933 - RNA, 22 nt, Artificial Sequence
  Synthetic
gaccaaaggaagggggcagaga

SEQ ID NO: 12934 - RNA, 23 nt, Artificial Sequence
  Synthetic
agaccaaaggaagggggcagaga

SEQ ID NO: 12935 - RNA, 24 nt, Artificial Sequence
  Synthetic
aagaccaaaggaagggggcagaga

SEQ ID NO: 12936 - RNA, 18 nt, Artificial Sequence
  Synthetic
gagaggcaggauuagaga

SEQ ID NO: 12937 - RNA, 19 nt, Artificial Sequence
  Synthetic
agagaggcaggauuagaga

SEQ ID NO: 12938 - RNA, 20 nt, Artificial Sequence
  Synthetic
aagagaggcaggauuagaga

SEQ ID NO: 12939 - RNA, 21 nt, Artificial Sequence
  Synthetic
gaagagaggcaggauuagaga

SEQ ID NO: 12940 - RNA, 22 nt, Artificial Sequence
  Synthetic
ggaagagaggcaggauuagaga

SEQ ID NO: 12941 - RNA, 23 nt, Artificial Sequence
  Synthetic
aggaagagaggcaggauuagaga

SEQ ID NO: 12942 - RNA, 24 nt, Artificial Sequence
  Synthetic
gaggaagagaggcaggauuagaga

SEQ ID NO: 12943 - RNA, 18 nt, Artificial Sequence
  Synthetic
gaccuggcucaagggaga

SEQ ID NO: 12944 - RNA, 19 nt, Artificial Sequence
  Synthetic
ggaccuggcucaagggaga

SEQ ID NO: 12945 - RNA, 20 nt, Artificial Sequence
  Synthetic
aggaccuggcucaagggaga

SEQ ID NO: 12946 - RNA, 21 nt, Artificial Sequence
  Synthetic
aaggaccuggcucaagggaga

SEQ ID NO: 12947 - RNA, 22 nt, Artificial Sequence
  Synthetic
uaaggaccuggcucaagggaga

SEQ ID NO: 12948 - RNA, 23 nt, Artificial Sequence
  Synthetic
guaaggaccuggcucaagggaga

SEQ ID NO: 12949 - RNA, 24 nt, Artificial Sequence
  Synthetic
uguaaggaccuggcucaagggaga

SEQ ID NO: 12950 - RNA, 18 nt, Artificial Sequence
  Synthetic
ugagggccuagagugaga

SEQ ID NO: 12951 - RNA, 19 nt, Artificial Sequence
  Synthetic
cugagggccuagagugaga

SEQ ID NO: 12952 - RNA, 21 nt, Artificial Sequence
  Synthetic
agcugagggccuagagugaga

SEQ ID NO: 12953 - RNA, 22 nt, Artificial Sequence
  Synthetic
gagcugagggccuagagugaga

SEQ ID NO: 12954 - RNA, 23 nt, Artificial Sequence
  Synthetic
ggagcugagggccuagagugaga

SEQ ID NO: 12955 - RNA, 24 nt, Artificial Sequence
  Synthetic
uggagcugagggccuagagugaga

SEQ ID NO: 12956 - RNA, 18 nt, Artificial Sequence
  Synthetic
aaacagaaggcagauaga

SEQ ID NO: 12957 - RNA, 19 nt, Artificial Sequence
  Synthetic
gaaacagaaggcagauaga

SEQ ID NO: 12958 - RNA, 20 nt, Artificial Sequence
  Synthetic
agaaacagaaggcagauaga

SEQ ID NO: 12959 - RNA, 21 nt, Artificial Sequence
  Synthetic
gagaaacagaaggcagauaga

SEQ ID NO: 12960 - RNA, 22 nt, Artificial Sequence
  Synthetic
agagaaacagaaggcagauaga

SEQ ID NO: 12961 - RNA, 23 nt, Artificial Sequence
  Synthetic
aagagaaacagaaggcagauaga

SEQ ID NO: 12962 - RNA, 24 nt, Artificial Sequence
  Synthetic
aaagagaaacagaaggcagauaga

SEQ ID NO: 12963 - RNA, 18 nt, Artificial Sequence
  Synthetic
uggagcugagggccuaga

SEQ ID NO: 12964 - RNA, 19 nt, Artificial Sequence
  Synthetic
cuggagcugagggccuaga

SEQ ID NO: 12965 - RNA, 20 nt, Artificial Sequence
  Synthetic
gcuggagcugagggccuaga

SEQ ID NO: 12966 - RNA, 21 nt, Artificial Sequence
  Synthetic
ggcuggagcugagggccuaga

SEQ ID NO: 12967 - RNA, 22 nt, Artificial Sequence
  Synthetic
aggcuggagcugagggccuaga

SEQ ID NO: 12968 - RNA, 23 nt, Artificial Sequence
  Synthetic
gaggcuggagcugagggccuaga

SEQ ID NO: 12969 - RNA, 24 nt, Artificial Sequence
  Synthetic
agaggcuggagcugagggccuaga

SEQ ID NO: 12970 - RNA, 18 nt, Artificial Sequence
  Synthetic
aagagaggcaggauuaga

SEQ ID NO: 12971 - RNA, 19 nt, Artificial Sequence
  Synthetic
gaagagaggcaggauuaga

SEQ ID NO: 12972 - RNA, 20 nt, Artificial Sequence
  Synthetic
ggaagagaggcaggauuaga

SEQ ID NO: 12973 - RNA, 21 nt, Artificial Sequence
  Synthetic
aggaagagaggcaggauuaga

SEQ ID NO: 12974 - RNA, 22 nt, Artificial Sequence
  Synthetic
gaggaagagaggcaggauuaga

SEQ ID NO: 12975 - RNA, 23 nt, Artificial Sequence
  Synthetic
agaggaagagaggcaggauuaga

SEQ ID NO: 12976 - RNA, 24 nt, Artificial Sequence
  Synthetic
gagaggaagagaggcaggauuaga

SEQ ID NO: 12977 - RNA, 18 nt, Artificial Sequence
  Synthetic
aggaagaagaccaaagga

SEQ ID NO: 12978 - RNA, 19 nt, Artificial Sequence
  Synthetic
gaggaagaagaccaaagga

SEQ ID NO: 12979 - RNA, 21 nt, Artificial Sequence
  Synthetic
uggaggaagaagaccaaagga

SEQ ID NO: 12980 - RNA, 22 nt, Artificial Sequence
  Synthetic
cuggaggaagaagaccaaagga

SEQ ID NO: 12981 - RNA, 23 nt, Artificial Sequence
  Synthetic
ccuggaggaagaagaccaaagga

SEQ ID NO: 12982 - RNA, 24 nt, Artificial Sequence
  Synthetic
uccuggaggaagaagaccaaagga

SEQ ID NO: 12983 - RNA, 18 nt, Artificial Sequence
  Synthetic
ggcgaggaaucagcagga

SEQ ID NO: 12984 - RNA, 19 nt, Artificial Sequence
  Synthetic
uggcgaggaaucagcagga

SEQ ID NO: 12985 - RNA, 20 nt, Artificial Sequence
  Synthetic
guggcgaggaaucagcagga

SEQ ID NO: 12986 - RNA, 21 nt, Artificial Sequence
  Synthetic
gguggcgaggaaucagcagga

SEQ ID NO: 12987 - RNA, 22 nt, Artificial Sequence
  Synthetic
ggguggcgaggaaucagcagga

SEQ ID NO: 12988 - RNA, 23 nt, Artificial Sequence
  Synthetic
gggguggcgaggaaucagcagga

SEQ ID NO: 12989 - RNA, 24 nt, Artificial Sequence
  Synthetic
ggggguggcgaggaaucagcagga

SEQ ID NO: 12990 - RNA, 18 nt, Artificial Sequence
  Synthetic
uggaggagggagggagga

SEQ ID NO: 12991 - RNA, 19 nt, Artificial Sequence
  Synthetic
guggaggagggagggagga

SEQ ID NO: 12992 - RNA, 20 nt, Artificial Sequence
  Synthetic
gguggaggagggagggagga

SEQ ID NO: 12993 - RNA, 21 nt, Artificial Sequence
  Synthetic
agguggaggagggagggagga

SEQ ID NO: 12994 - RNA, 22 nt, Artificial Sequence
  Synthetic
aagguggaggagggagggagga

SEQ ID NO: 12995 - RNA, 23 nt, Artificial Sequence
  Synthetic
aaagguggaggagggagggagga

SEQ ID NO: 12996 - RNA, 24 nt, Artificial Sequence
  Synthetic
gaaagguggaggagggagggagga

SEQ ID NO: 12997 - RNA, 18 nt, Artificial Sequence
  Synthetic
uccaggaaagguggagga

SEQ ID NO: 12998 - RNA, 19 nt, Artificial Sequence
  Synthetic
cuccaggaaagguggagga

SEQ ID NO: 12999 - RNA, 21 nt, Artificial Sequence
  Synthetic
ggcuccaggaaagguggagga

SEQ ID NO: 13000 - RNA, 22 nt, Artificial Sequence
  Synthetic
uggcuccaggaaagguggagga

SEQ ID NO: 13001 - RNA, 23 nt, Artificial Sequence
  Synthetic
cuggcuccaggaaagguggagga

SEQ ID NO: 13002 - RNA, 24 nt, Artificial Sequence
  Synthetic
gcuggcuccaggaaagguggagga

SEQ ID NO: 13003 - RNA, 18 nt, Artificial Sequence
  Synthetic
aaggcagauagagaggga

SEQ ID NO: 13004 - RNA, 19 nt, Artificial Sequence
  Synthetic
gaaggcagauagagaggga

SEQ ID NO: 13005 - RNA, 20 nt, Artificial Sequence
  Synthetic
agaaggcagauagagaggga

SEQ ID NO: 13006 - RNA, 21 nt, Artificial Sequence
  Synthetic
cagaaggcagauagagaggga

SEQ ID NO: 13007 - RNA, 22 nt, Artificial Sequence
  Synthetic
acagaaggcagauagagaggga

SEQ ID NO: 13008 - RNA, 23 nt, Artificial Sequence
  Synthetic
aacagaaggcagauagagaggga

SEQ ID NO: 13009 - RNA, 24 nt, Artificial Sequence
  Synthetic
aaacagaaggcagauagagaggga

SEQ ID NO: 13010 - RNA, 18 nt, Artificial Sequence
  Synthetic
ggaaagguggaggaggga

SEQ ID NO: 13011 - RNA, 19 nt, Artificial Sequence
  Synthetic
aggaaagguggaggaggga

SEQ ID NO: 13012 - RNA, 21 nt, Artificial Sequence
  Synthetic
ccaggaaagguggaggaggga

SEQ ID NO: 13013 - RNA, 22 nt, Artificial Sequence
  Synthetic
uccaggaaagguggaggaggga

SEQ ID NO: 13014 - RNA, 23 nt, Artificial Sequence
  Synthetic
cuccaggaaagguggaggaggga

SEQ ID NO: 13015 - RNA, 24 nt, Artificial Sequence
  Synthetic
gcuccaggaaagguggaggaggga

SEQ ID NO: 13016 - RNA, 18 nt, Artificial Sequence
  Synthetic
ggcaaggcaaggggggga

SEQ ID NO: 13017 - RNA, 19 nt, Artificial Sequence
  Synthetic
gggcaaggcaaggggggga

SEQ ID NO: 13018 - RNA, 20 nt, Artificial Sequence
  Synthetic
ggggcaaggcaaggggggga

SEQ ID NO: 13019 - RNA, 21 nt, Artificial Sequence
  Synthetic
gggggcaaggcaaggggggga

SEQ ID NO: 13020 - RNA, 22 nt, Artificial Sequence
  Synthetic
agggggcaaggcaaggggggga

SEQ ID NO: 13021 - RNA, 23 nt, Artificial Sequence
  Synthetic
gagggggcaaggcaaggggggga

SEQ ID NO: 13022 - RNA, 24 nt, Artificial Sequence
  Synthetic
agagggggcaaggcaaggggggga

SEQ ID NO: 13023 - RNA, 18 nt, Artificial Sequence
  Synthetic
uccagccgcaaccuggga

SEQ ID NO: 13024 - RNA, 19 nt, Artificial Sequence
  Synthetic
guccagccgcaaccuggga

SEQ ID NO: 13025 - RNA, 20 nt, Artificial Sequence
  Synthetic
aguccagccgcaaccuggga

SEQ ID NO: 13026 - RNA, 21 nt, Artificial Sequence
  Synthetic
caguccagccgcaaccuggga

SEQ ID NO: 13027 - RNA, 22 nt, Artificial Sequence
  Synthetic
ccaguccagccgcaaccuggga

SEQ ID NO: 13028 - RNA, 23 nt, Artificial Sequence
  Synthetic
cccaguccagccgcaaccuggga

SEQ ID NO: 13029 - RNA, 24 nt, Artificial Sequence
  Synthetic
ucccaguccagccgcaaccuggga

SEQ ID NO: 13030 - RNA, 18 nt, Artificial Sequence
  Synthetic
cacgggcucuguguggga

SEQ ID NO: 13031 - RNA, 19 nt, Artificial Sequence
  Synthetic
ccacgggcucuguguggga

SEQ ID NO: 13032 - RNA, 20 nt, Artificial Sequence
  Synthetic
uccacgggcucuguguggga

SEQ ID NO: 13033 - RNA, 21 nt, Artificial Sequence
  Synthetic
auccacgggcucuguguggga

SEQ ID NO: 13034 - RNA, 22 nt, Artificial Sequence
  Synthetic
aauccacgggcucuguguggga

SEQ ID NO: 13035 - RNA, 23 nt, Artificial Sequence
  Synthetic
gaauccacgggcucuguguggga

SEQ ID NO: 13036 - RNA, 24 nt, Artificial Sequence
  Synthetic
cgaauccacgggcucuguguggga

SEQ ID NO: 13037 - RNA, 18 nt, Artificial Sequence
  Synthetic
cugccagauucaacugga

SEQ ID NO: 13038 - RNA, 19 nt, Artificial Sequence
  Synthetic
gcugccagauucaacugga

SEQ ID NO: 13039 - RNA, 20 nt, Artificial Sequence
  Synthetic
ggcugccagauucaacugga

SEQ ID NO: 13040 - RNA, 21 nt, Artificial Sequence
  Synthetic
uggcugccagauucaacugga

SEQ ID NO: 13041 - RNA, 22 nt, Artificial Sequence
  Synthetic
uuggcugccagauucaacugga

SEQ ID NO: 13042 - RNA, 23 nt, Artificial Sequence
  Synthetic
uuuggcugccagauucaacugga

SEQ ID NO: 13043 - RNA, 24 nt, Artificial Sequence
  Synthetic
guuuggcugccagauucaacugga

SEQ ID NO: 13044 - RNA, 18 nt, Artificial Sequence
  Synthetic
ugucugcuggcuugugga

SEQ ID NO: 13045 - RNA, 19 nt, Artificial Sequence
  Synthetic
uugucugcuggcuugugga

SEQ ID NO: 13046 - RNA, 21 nt, Artificial Sequence
  Synthetic
cuuugucugcuggcuugugga

SEQ ID NO: 13047 - RNA, 22 nt, Artificial Sequence
  Synthetic
ccuuugucugcuggcuugugga

SEQ ID NO: 13048 - RNA, 23 nt, Artificial Sequence
  Synthetic
gccuuugucugcuggcuugugga

SEQ ID NO: 13049 - RNA, 24 nt, Artificial Sequence
  Synthetic
ggccuuugucugcuggcuugugga

SEQ ID NO: 13050 - RNA, 18 nt, Artificial Sequence
  Synthetic
ugcugcauuaaguuugga

SEQ ID NO: 13051 - RNA, 19 nt, Artificial Sequence
  Synthetic
uugcugcauuaaguuugga

SEQ ID NO: 13052 - RNA, 20 nt, Artificial Sequence
  Synthetic
uuugcugcauuaaguuugga

SEQ ID NO: 13053 - RNA, 21 nt, Artificial Sequence
  Synthetic
uuuugcugcauuaaguuugga

SEQ ID NO: 13054 - RNA, 22 nt, Artificial Sequence
  Synthetic
cuuuugcugcauuaaguuugga

SEQ ID NO: 13055 - RNA, 23 nt, Artificial Sequence
  Synthetic
ccuuuugcugcauuaaguuugga

SEQ ID NO: 13056 - RNA, 24 nt, Artificial Sequence
  Synthetic
uccuuuugcugcauuaaguuugga

SEQ ID NO: 13057 - RNA, 18 nt, Artificial Sequence
  Synthetic
gcugagggccuagaguga

SEQ ID NO: 13058 - RNA, 19 nt, Artificial Sequence
  Synthetic
agcugagggccuagaguga

SEQ ID NO: 13059 - RNA, 20 nt, Artificial Sequence
  Synthetic
gagcugagggccuagaguga

SEQ ID NO: 13060 - RNA, 21 nt, Artificial Sequence
  Synthetic
ggagcugagggccuagaguga

SEQ ID NO: 13061 - RNA, 22 nt, Artificial Sequence
  Synthetic
uggagcugagggccuagaguga

SEQ ID NO: 13062 - RNA, 23 nt, Artificial Sequence
  Synthetic
cuggagcugagggccuagaguga

SEQ ID NO: 13063 - RNA, 24 nt, Artificial Sequence
  Synthetic
gcuggagcugagggccuagaguga

SEQ ID NO: 13064 - RNA, 18 nt, Artificial Sequence
  Synthetic
ggcucugugugggaguga

SEQ ID NO: 13065 - RNA, 19 nt, Artificial Sequence
  Synthetic
gggcucugugugggaguga

SEQ ID NO: 13066 - RNA, 21 nt, Artificial Sequence
  Synthetic
acgggcucugugugggaguga

SEQ ID NO: 13067 - RNA, 22 nt, Artificial Sequence
  Synthetic
cacgggcucugugugggaguga

SEQ ID NO: 13068 - RNA, 23 nt, Artificial Sequence
  Synthetic
ccacgggcucugugugggaguga

SEQ ID NO: 13069 - RNA, 24 nt, Artificial Sequence
  Synthetic
uccacgggcucugugugggaguga

SEQ ID NO: 13070 - RNA, 18 nt, Artificial Sequence
  Synthetic
gcugcucccacuuaguga

SEQ ID NO: 13071 - RNA, 19 nt, Artificial Sequence
  Synthetic
cgcugcucccacuuaguga

SEQ ID NO: 13072 - RNA, 20 nt, Artificial Sequence
  Synthetic
gcgcugcucccacuuaguga

SEQ ID NO: 13073 - RNA, 21 nt, Artificial Sequence
  Synthetic
ugcgcugcucccacuuaguga

SEQ ID NO: 13074 - RNA, 22 nt, Artificial Sequence
  Synthetic
gugcgcugcucccacuuaguga

SEQ ID NO: 13075 - RNA, 23 nt, Artificial Sequence
  Synthetic
agugcgcugcucccacuuaguga

SEQ ID NO: 13076 - RNA, 24 nt, Artificial Sequence
  Synthetic
gagugcgcugcucccacuuaguga

SEQ ID NO: 13077 - RNA, 18 nt, Artificial Sequence
  Synthetic
gcugcaccugucagguga

SEQ ID NO: 13078 - RNA, 19 nt, Artificial Sequence
  Synthetic
cgcugcaccugucagguga

SEQ ID NO: 13079 - RNA, 21 nt, Artificial Sequence
  Synthetic
gccgcugcaccugucagguga

SEQ ID NO: 13080 - RNA, 22 nt, Artificial Sequence
  Synthetic
ggccgcugcaccugucagguga

SEQ ID NO: 13081 - RNA, 23 nt, Artificial Sequence
  Synthetic
aggccgcugcaccugucagguga

SEQ ID NO: 13082 - RNA, 24 nt, Artificial Sequence
  Synthetic
caggccgcugcaccugucagguga

SEQ ID NO: 13083 - RNA, 18 nt, Artificial Sequence
  Synthetic
agaaacagaaggcagaua

SEQ ID NO: 13084 - RNA, 19 nt, Artificial Sequence
  Synthetic
gagaaacagaaggcagaua

SEQ ID NO: 13085 - RNA, 20 nt, Artificial Sequence
  Synthetic
agagaaacagaaggcagaua

SEQ ID NO: 13086 - RNA, 21 nt, Artificial Sequence
  Synthetic
aagagaaacagaaggcagaua

SEQ ID NO: 13087 - RNA, 22 nt, Artificial Sequence
  Synthetic
aaagagaaacagaaggcagaua

SEQ ID NO: 13088 - RNA, 23 nt, Artificial Sequence
  Synthetic
caaagagaaacagaaggcagaua

SEQ ID NO: 13089 - RNA, 24 nt, Artificial Sequence
  Synthetic
ccaaagagaaacagaaggcagaua

SEQ ID NO: 13090 - RNA, 18 nt, Artificial Sequence
  Synthetic
ccuuuaauugagaugcua

SEQ ID NO: 13091 - RNA, 19 nt, Artificial Sequence
  Synthetic
accuuuaauugagaugcua

SEQ ID NO: 13092 - RNA, 20 nt, Artificial Sequence
  Synthetic
caccuuuaauugagaugcua

SEQ ID NO: 13093 - RNA, 21 nt, Artificial Sequence
  Synthetic
ucaccuuuaauugagaugcua

SEQ ID NO: 13094 - RNA, 22 nt, Artificial Sequence
  Synthetic
cucaccuuuaauugagaugcua

SEQ ID NO: 13095 - RNA, 23 nt, Artificial Sequence
  Synthetic
gcucaccuuuaauugagaugcua

SEQ ID NO: 13096 - RNA, 24 nt, Artificial Sequence
  Synthetic
ugcucaccuuuaauugagaugcua

SEQ ID NO: 13097 - RNA, 18 nt, Artificial Sequence
  Synthetic
agaggagaggccguucua

SEQ ID NO: 13098 - RNA, 19 nt, Artificial Sequence
  Synthetic
cagaggagaggccguucua

SEQ ID NO: 13099 - RNA, 21 nt, Artificial Sequence
  Synthetic
agcagaggagaggccguucua

SEQ ID NO: 13100 - RNA, 22 nt, Artificial Sequence
  Synthetic
aagcagaggagaggccguucua

SEQ ID NO: 13101 - RNA, 23 nt, Artificial Sequence
  Synthetic
gaagcagaggagaggccguucua

SEQ ID NO: 13102 - RNA, 24 nt, Artificial Sequence
  Synthetic
ggaagcagaggagaggccguucua

SEQ ID NO: 13103 - RNA, 18 nt, Artificial Sequence
  Synthetic
ggaagagaggcaggauua

SEQ ID NO: 13104 - RNA, 19 nt, Artificial Sequence
  Synthetic
aggaagagaggcaggauua

SEQ ID NO: 13105 - RNA, 20 nt, Artificial Sequence
  Synthetic
gaggaagagaggcaggauua

SEQ ID NO: 13106 - RNA, 21 nt, Artificial Sequence
  Synthetic
agaggaagagaggcaggauua

SEQ ID NO: 13107 - RNA, 22 nt, Artificial Sequence
  Synthetic
gagaggaagagaggcaggauua

SEQ ID NO: 13108 - RNA, 23 nt, Artificial Sequence
  Synthetic
ggagaggaagagaggcaggauua

SEQ ID NO: 13109 - RNA, 24 nt, Artificial Sequence
  Synthetic
gggagaggaagagaggcaggauua

SEQ ID NO: 13110 - RNA, 18 nt, Artificial Sequence
  Synthetic
gugcgcugcucccacuua

SEQ ID NO: 13111 - RNA, 19 nt, Artificial Sequence
  Synthetic
agugcgcugcucccacuua

SEQ ID NO: 13112 - RNA, 20 nt, Artificial Sequence
  Synthetic
gagugcgcugcucccacuua

SEQ ID NO: 13113 - RNA, 21 nt, Artificial Sequence
  Synthetic
ugagugcgcugcucccacuua

SEQ ID NO: 13114 - RNA, 22 nt, Artificial Sequence
  Synthetic
cugagugcgcugcucccacuua

SEQ ID NO: 13115 - RNA, 23 nt, Artificial Sequence
  Synthetic
ccugagugcgcugcucccacuua

SEQ ID NO: 13116 - RNA, 24 nt, Artificial Sequence
  Synthetic
accugagugcgcugcucccacuua

SEQ ID NO: 13117 - RNA, 18 nt, Artificial Sequence
  Synthetic
gaggugcuaggacaaaac

SEQ ID NO: 13118 - RNA, 19 nt, Artificial Sequence
  Synthetic
ggaggugcuaggacaaaac

SEQ ID NO: 13119 - RNA, 20 nt, Artificial Sequence
  Synthetic
gggaggugcuaggacaaaac

SEQ ID NO: 13120 - RNA, 21 nt, Artificial Sequence
  Synthetic
agggaggugcuaggacaaaac

SEQ ID NO: 13121 - RNA, 22 nt, Artificial Sequence
  Synthetic
aagggaggugcuaggacaaaac

SEQ ID NO: 13122 - RNA, 23 nt, Artificial Sequence
  Synthetic
aaagggaggugcuaggacaaaac

SEQ ID NO: 13123 - RNA, 24 nt, Artificial Sequence
  Synthetic
gaaagggaggugcuaggacaaaac

SEQ ID NO: 13124 - RNA, 18 nt, Artificial Sequence
  Synthetic
ucccaguccagccgcaac

SEQ ID NO: 13125 - RNA, 19 nt, Artificial Sequence
  Synthetic
gucccaguccagccgcaac

SEQ ID NO: 13126 - RNA, 20 nt, Artificial Sequence
  Synthetic
agucccaguccagccgcaac

SEQ ID NO: 13127 - RNA, 21 nt, Artificial Sequence
  Synthetic
cagucccaguccagccgcaac

SEQ ID NO: 13128 - RNA, 22 nt, Artificial Sequence
  Synthetic
ccagucccaguccagccgcaac

SEQ ID NO: 13129 - RNA, 23 nt, Artificial Sequence
  Synthetic
accagucccaguccagccgcaac

SEQ ID NO: 13130 - RNA, 24 nt, Artificial Sequence
  Synthetic
aaccagucccaguccagccgcaac

SEQ ID NO: 13131 - RNA, 18 nt, Artificial Sequence
  Synthetic
uuggcugccagauucaac

SEQ ID NO: 13132 - RNA, 19 nt, Artificial Sequence
  Synthetic
uuuggcugccagauucaac

SEQ ID NO: 13133 - RNA, 21 nt, Artificial Sequence
  Synthetic
gguuuggcugccagauucaac

SEQ ID NO: 13134 - RNA, 22 nt, Artificial Sequence
  Synthetic
agguuuggcugccagauucaac

SEQ ID NO: 13135 - RNA, 23 nt, Artificial Sequence
  Synthetic
gagguuuggcugccagauucaac

SEQ ID NO: 13136 - RNA, 24 nt, Artificial Sequence
  Synthetic
agagguuuggcugccagauucaac

SEQ ID NO: 13137 - RNA, 18 nt, Artificial Sequence
  Synthetic
uagcuccuggaagcacac

SEQ ID NO: 13138 - RNA, 19 nt, Artificial Sequence
  Synthetic
cuagcuccuggaagcacac

SEQ ID NO: 13139 - RNA, 20 nt, Artificial Sequence
  Synthetic
ucuagcuccuggaagcacac

SEQ ID NO: 13140 - RNA, 21 nt, Artificial Sequence
  Synthetic
cucuagcuccuggaagcacac

SEQ ID NO: 13141 - RNA, 22 nt, Artificial Sequence
  Synthetic
ccucuagcuccuggaagcacac

SEQ ID NO: 13142 - RNA, 23 nt, Artificial Sequence
  Synthetic
gccucuagcuccuggaagcacac

SEQ ID NO: 13143 - RNA, 24 nt, Artificial Sequence
  Synthetic
agccucuagcuccuggaagcacac

SEQ ID NO: 13144 - RNA, 18 nt, Artificial Sequence
  Synthetic
uuucacauccaggugcac

SEQ ID NO: 13145 - RNA, 19 nt, Artificial Sequence
  Synthetic
cuuucacauccaggugcac

SEQ ID NO: 13146 - RNA, 20 nt, Artificial Sequence
  Synthetic
gcuuucacauccaggugcac

SEQ ID NO: 13147 - RNA, 21 nt, Artificial Sequence
  Synthetic
ggcuuucacauccaggugcac

SEQ ID NO: 13148 - RNA, 22 nt, Artificial Sequence
  Synthetic
cggcuuucacauccaggugcac

SEQ ID NO: 13149 - RNA, 23 nt, Artificial Sequence
  Synthetic
ccggcuuucacauccaggugcac

SEQ ID NO: 13150 - RNA, 24 nt, Artificial Sequence
  Synthetic
cccggcuuucacauccaggugcac

SEQ ID NO: 13151 - RNA, 18 nt, Artificial Sequence
  Synthetic
ccuagcccccagcuucac

SEQ ID NO: 13152 - RNA, 19 nt, Artificial Sequence
  Synthetic
gccuagcccccagcuucac

SEQ ID NO: 13153 - RNA, 20 nt, Artificial Sequence
  Synthetic
cgccuagcccccagcuucac

SEQ ID NO: 13154 - RNA, 21 nt, Artificial Sequence
  Synthetic
ccgccuagcccccagcuucac

SEQ ID NO: 13155 - RNA, 22 nt, Artificial Sequence
  Synthetic
cccgccuagcccccagcuucac

SEQ ID NO: 13156 - RNA, 23 nt, Artificial Sequence
  Synthetic
ccccgccuagcccccagcuucac

SEQ ID NO: 13157 - RNA, 24 nt, Artificial Sequence
  Synthetic
gccccgccuagcccccagcuucac

SEQ ID NO: 13158 - RNA, 18 nt, Artificial Sequence
  Synthetic
gcaggaaagaggagggac

SEQ ID NO: 13159 - RNA, 19 nt, Artificial Sequence
  Synthetic
agcaggaaagaggagggac

SEQ ID NO: 13160 - RNA, 20 nt, Artificial Sequence
  Synthetic
cagcaggaaagaggagggac

SEQ ID NO: 13161 - RNA, 21 nt, Artificial Sequence
  Synthetic
ucagcaggaaagaggagggac

SEQ ID NO: 13162 - RNA, 22 nt, Artificial Sequence
  Synthetic
aucagcaggaaagaggagggac

SEQ ID NO: 13163 - RNA, 23 nt, Artificial Sequence
  Synthetic
aaucagcaggaaagaggagggac

SEQ ID NO: 13164 - RNA, 24 nt, Artificial Sequence
  Synthetic
gaaucagcaggaaagaggagggac

SEQ ID NO: 13165 - RNA, 18 nt, Artificial Sequence
  Synthetic
cccaguccagccgcaacc

SEQ ID NO: 13166 - RNA, 19 nt, Artificial Sequence
  Synthetic
ucccaguccagccgcaacc

SEQ ID NO: 13167 - RNA, 21 nt, Artificial Sequence
  Synthetic
agucccaguccagccgcaacc

SEQ ID NO: 13168 - RNA, 22 nt, Artificial Sequence
  Synthetic
cagucccaguccagccgcaacc

SEQ ID NO: 13169 - RNA, 23 nt, Artificial Sequence
  Synthetic
ccagucccaguccagccgcaacc

SEQ ID NO: 13170 - RNA, 24 nt, Artificial Sequence
  Synthetic
accagucccaguccagccgcaacc

SEQ ID NO: 13171 - RNA, 18 nt, Artificial Sequence
  Synthetic
aggagauaacccagcacc

SEQ ID NO: 13172 - RNA, 19 nt, Artificial Sequence
  Synthetic
aaggagauaacccagcacc

SEQ ID NO: 13173 - RNA, 20 nt, Artificial Sequence
  Synthetic
caaggagauaacccagcacc

SEQ ID NO: 13174 - RNA, 21 nt, Artificial Sequence
  Synthetic
ccaaggagauaacccagcacc

SEQ ID NO: 13175 - RNA, 22 nt, Artificial Sequence
  Synthetic
gccaaggagauaacccagcacc

SEQ ID NO: 13176 - RNA, 23 nt, Artificial Sequence
  Synthetic
agccaaggagauaacccagcacc

SEQ ID NO: 13177 - RNA, 24 nt, Artificial Sequence
  Synthetic
gagccaaggagauaacccagcacc

SEQ ID NO: 13178 - RNA, 18 nt, Artificial Sequence
  Synthetic
caggaaagaggagggacc

SEQ ID NO: 13179 - RNA, 19 nt, Artificial Sequence
  Synthetic
gcaggaaagaggagggacc

SEQ ID NO: 13180 - RNA, 21 nt, Artificial Sequence
  Synthetic
cagcaggaaagaggagggacc

SEQ ID NO: 13181 - RNA, 22 nt, Artificial Sequence
  Synthetic
ucagcaggaaagaggagggacc

SEQ ID NO: 13182 - RNA, 23 nt, Artificial Sequence
  Synthetic
aucagcaggaaagaggagggacc

SEQ ID NO: 13183 - RNA, 24 nt, Artificial Sequence
  Synthetic
aaucagcaggaaagaggagggacc

SEQ ID NO: 13184 - RNA, 18 nt, Artificial Sequence
  Synthetic
cacagaccagguuggacc

SEQ ID NO: 13185 - RNA, 19 nt, Artificial Sequence
  Synthetic
ccacagaccagguuggacc

SEQ ID NO: 13186 - RNA, 20 nt, Artificial Sequence
  Synthetic
gccacagaccagguuggacc

SEQ ID NO: 13187 - RNA, 21 nt, Artificial Sequence
  Synthetic
agccacagaccagguuggacc

SEQ ID NO: 13188 - RNA, 22 nt, Artificial Sequence
  Synthetic
aagccacagaccagguuggacc

SEQ ID NO: 13189 - RNA, 23 nt, Artificial Sequence
  Synthetic
gaagccacagaccagguuggacc

SEQ ID NO: 13190 - RNA, 24 nt, Artificial Sequence
  Synthetic
ggaagccacagaccagguuggacc

SEQ ID NO: 13191 - RNA, 18 nt, Artificial Sequence
  Synthetic
gcgcuaaguagauagccc

SEQ ID NO: 13192 - RNA, 19 nt, Artificial Sequence
  Synthetic
agcgcuaaguagauagccc

SEQ ID NO: 13193 - RNA, 20 nt, Artificial Sequence
  Synthetic
aagcgcuaaguagauagccc

SEQ ID NO: 13194 - RNA, 21 nt, Artificial Sequence
  Synthetic
aaagcgcuaaguagauagccc

SEQ ID NO: 13195 - RNA, 22 nt, Artificial Sequence
  Synthetic
aaaagcgcuaaguagauagccc

SEQ ID NO: 13196 - RNA, 23 nt, Artificial Sequence
  Synthetic
caaaagcgcuaaguagauagccc

SEQ ID NO: 13197 - RNA, 24 nt, Artificial Sequence
  Synthetic
gcaaaagcgcuaaguagauagccc

SEQ ID NO: 13198 - RNA, 18 nt, Artificial Sequence
  Synthetic
cugccuccuguggggccc

SEQ ID NO: 13199 - RNA, 19 nt, Artificial Sequence
  Synthetic
gcugccuccuguggggccc

SEQ ID NO: 13200 - RNA, 20 nt, Artificial Sequence
  Synthetic
ggcugccuccuguggggccc

SEQ ID NO: 13201 - RNA, 21 nt, Artificial Sequence
  Synthetic
gggcugccuccuguggggccc

SEQ ID NO: 13202 - RNA, 22 nt, Artificial Sequence
  Synthetic
ugggcugccuccuguggggccc

SEQ ID NO: 13203 - RNA, 23 nt, Artificial Sequence
  Synthetic
cugggcugccuccuguggggccc

SEQ ID NO: 13204 - RNA, 24 nt, Artificial Sequence
  Synthetic
ucugggcugccuccuguggggccc

SEQ ID NO: 13205 - RNA, 18 nt, Artificial Sequence
  Synthetic
cucccaguucaccugccc

SEQ ID NO: 13206 - RNA, 19 nt, Artificial Sequence
  Synthetic
acucccaguucaccugccc

SEQ ID NO: 13207 - RNA, 20 nt, Artificial Sequence
  Synthetic
uacucccaguucaccugccc

SEQ ID NO: 13208 - RNA, 21 nt, Artificial Sequence
  Synthetic
guacucccaguucaccugccc

SEQ ID NO: 13209 - RNA, 22 nt, Artificial Sequence
  Synthetic
aguacucccaguucaccugccc

SEQ ID NO: 13210 - RNA, 23 nt, Artificial Sequence
  Synthetic
caguacucccaguucaccugccc

SEQ ID NO: 13211 - RNA, 24 nt, Artificial Sequence
  Synthetic
ccaguacucccaguucaccugccc

SEQ ID NO: 13212 - RNA, 18 nt, Artificial Sequence
  Synthetic
gcugaccugugggugccc

SEQ ID NO: 13213 - RNA, 19 nt, Artificial Sequence
  Synthetic
ggcugaccugugggugccc

SEQ ID NO: 13214 - RNA, 20 nt, Artificial Sequence
  Synthetic
aggcugaccugugggugccc

SEQ ID NO: 13215 - RNA, 21 nt, Artificial Sequence
  Synthetic
gaggcugaccugugggugccc

SEQ ID NO: 13216 - RNA, 22 nt, Artificial Sequence
  Synthetic
ugaggcugaccugugggugccc

SEQ ID NO: 13217 - RNA, 23 nt, Artificial Sequence
  Synthetic
gugaggcugaccugugggugccc

SEQ ID NO: 13218 - RNA, 24 nt, Artificial Sequence
  Synthetic
ggugaggcugaccugugggugccc

SEQ ID NO: 13219 - RNA, 18 nt, Artificial Sequence
  Synthetic
agaccuuuucacagagcc

SEQ ID NO: 13220 - RNA, 19 nt, Artificial Sequence
  Synthetic
gagaccuuuucacagagcc

SEQ ID NO: 13221 - RNA, 20 nt, Artificial Sequence
  Synthetic
agagaccuuuucacagagcc

SEQ ID NO: 13222 - RNA, 21 nt, Artificial Sequence
  Synthetic
cagagaccuuuucacagagcc

SEQ ID NO: 13223 - RNA, 22 nt, Artificial Sequence
  Synthetic
gcagagaccuuuucacagagcc

SEQ ID NO: 13224 - RNA, 23 nt, Artificial Sequence
  Synthetic
ugcagagaccuuuucacagagcc

SEQ ID NO: 13225 - RNA, 24 nt, Artificial Sequence
  Synthetic
gugcagagaccuuuucacagagcc

SEQ ID NO: 13226 - RNA, 18 nt, Artificial Sequence
  Synthetic
cagagagcagacgaaucc

SEQ ID NO: 13227 - RNA, 19 nt, Artificial Sequence
  Synthetic
ccagagagcagacgaaucc

SEQ ID NO: 13228 - RNA, 20 nt, Artificial Sequence
  Synthetic
cccagagagcagacgaaucc

SEQ ID NO: 13229 - RNA, 21 nt, Artificial Sequence
  Synthetic
acccagagagcagacgaaucc

SEQ ID NO: 13230 - RNA, 22 nt, Artificial Sequence
  Synthetic
cacccagagagcagacgaaucc

SEQ ID NO: 13231 - RNA, 23 nt, Artificial Sequence
  Synthetic
gcacccagagagcagacgaaucc

SEQ ID NO: 13232 - RNA, 24 nt, Artificial Sequence
  Synthetic
agcacccagagagcagacgaaucc

SEQ ID NO: 13233 - RNA, 18 nt, Artificial Sequence
  Synthetic
gagcugagacacagaucc

SEQ ID NO: 13234 - RNA, 19 nt, Artificial Sequence
  Synthetic
ggagcugagacacagaucc

SEQ ID NO: 13235 - RNA, 21 nt, Artificial Sequence
  Synthetic
caggagcugagacacagaucc

SEQ ID NO: 13236 - RNA, 22 nt, Artificial Sequence
  Synthetic
gcaggagcugagacacagaucc

SEQ ID NO: 13237 - RNA, 23 nt, Artificial Sequence
  Synthetic
ggcaggagcugagacacagaucc

SEQ ID NO: 13238 - RNA, 24 nt, Artificial Sequence
  Synthetic
aggcaggagcugagacacagaucc

SEQ ID NO: 13239 - RNA, 18 nt, Artificial Sequence
  Synthetic
cagaaaacugauuuaucc

SEQ ID NO: 13240 - RNA, 19 nt, Artificial Sequence
  Synthetic
ucagaaaacugauuuaucc

SEQ ID NO: 13241 - RNA, 20 nt, Artificial Sequence
  Synthetic
cucagaaaacugauuuaucc

SEQ ID NO: 13242 - RNA, 21 nt, Artificial Sequence
  Synthetic
ccucagaaaacugauuuaucc

SEQ ID NO: 13243 - RNA, 22 nt, Artificial Sequence
  Synthetic
accucagaaaacugauuuaucc

SEQ ID NO: 13244 - RNA, 23 nt, Artificial Sequence
  Synthetic
aaccucagaaaacugauuuaucc

SEQ ID NO: 13245 - RNA, 24 nt, Artificial Sequence
  Synthetic
uaaccucagaaaacugauuuaucc

SEQ ID NO: 13246 - RNA, 18 nt, Artificial Sequence
  Synthetic
gaggcagcccagaccucc

SEQ ID NO: 13247 - RNA, 19 nt, Artificial Sequence
  Synthetic
ggaggcagcccagaccucc

SEQ ID NO: 13248 - RNA, 21 nt, Artificial Sequence
  Synthetic
cuggaggcagcccagaccucc

SEQ ID NO: 13249 - RNA, 22 nt, Artificial Sequence
  Synthetic
gcuggaggcagcccagaccucc

SEQ ID NO: 13250 - RNA, 23 nt, Artificial Sequence
  Synthetic
agcuggaggcagcccagaccucc

SEQ ID NO: 13251 - RNA, 24 nt, Artificial Sequence
  Synthetic
aagcuggaggcagcccagaccucc

SEQ ID NO: 13252 - RNA, 18 nt, Artificial Sequence
  Synthetic
acgaauuucuccuccucc

SEQ ID NO: 13253 - RNA, 19 nt, Artificial Sequence
  Synthetic
aacgaauuucuccuccucc

SEQ ID NO: 13254 - RNA, 20 nt, Artificial Sequence
  Synthetic
caacgaauuucuccuccucc

SEQ ID NO: 13255 - RNA, 21 nt, Artificial Sequence
  Synthetic
ucaacgaauuucuccuccucc

SEQ ID NO: 13256 - RNA, 22 nt, Artificial Sequence
  Synthetic
aucaacgaauuucuccuccucc

SEQ ID NO: 13257 - RNA, 23 nt, Artificial Sequence
  Synthetic
caucaacgaauuucuccuccucc

SEQ ID NO: 13258 - RNA, 24 nt, Artificial Sequence
  Synthetic
ccaucaacgaauuucuccuccucc

SEQ ID NO: 13259 - RNA, 18 nt, Artificial Sequence
  Synthetic
ugcugagccucuagcucc

SEQ ID NO: 13260 - RNA, 19 nt, Artificial Sequence
  Synthetic
uugcugagccucuagcucc

SEQ ID NO: 13261 - RNA, 21 nt, Artificial Sequence
  Synthetic
acuugcugagccucuagcucc

SEQ ID NO: 13262 - RNA, 22 nt, Artificial Sequence
  Synthetic
cacuugcugagccucuagcucc

SEQ ID NO: 13263 - RNA, 23 nt, Artificial Sequence
  Synthetic
ccacuugcugagccucuagcucc

SEQ ID NO: 13264 - RNA, 24 nt, Artificial Sequence
  Synthetic
cccacuugcugagccucuagcucc

SEQ ID NO: 13265 - RNA, 18 nt, Artificial Sequence
  Synthetic
cgcaggucugcuggcucc

SEQ ID NO: 13266 - RNA, 19 nt, Artificial Sequence
  Synthetic
ccgcaggucugcuggcucc

SEQ ID NO: 13267 - RNA, 21 nt, Artificial Sequence
  Synthetic
ucccgcaggucugcuggcucc

SEQ ID NO: 13268 - RNA, 22 nt, Artificial Sequence
  Synthetic
cucccgcaggucugcuggcucc

SEQ ID NO: 13269 - RNA, 23 nt, Artificial Sequence
  Synthetic
acucccgcaggucugcuggcucc

SEQ ID NO: 13270 - RNA, 24 nt, Artificial Sequence
  Synthetic
aacucccgcaggucugcuggcucc

SEQ ID NO: 13271 - RNA, 18 nt, Artificial Sequence
  Synthetic
ccuggagcccugcagucc

SEQ ID NO: 13272 - RNA, 19 nt, Artificial Sequence
  Synthetic
uccuggagcccugcagucc

SEQ ID NO: 13273 - RNA, 21 nt, Artificial Sequence
  Synthetic
ccuccuggagcccugcagucc

SEQ ID NO: 13274 - RNA, 22 nt, Artificial Sequence
  Synthetic
accuccuggagcccugcagucc

SEQ ID NO: 13275 - RNA, 23 nt, Artificial Sequence
  Synthetic
gaccuccuggagcccugcagucc

SEQ ID NO: 13276 - RNA, 24 nt, Artificial Sequence
  Synthetic
agaccuccuggagcccugcagucc

SEQ ID NO: 13277 - RNA, 18 nt, Artificial Sequence
  Synthetic
aaaaagaacagaaugucc

SEQ ID NO: 13278 - RNA, 19 nt, Artificial Sequence
  Synthetic
aaaaaagaacagaaugucc

SEQ ID NO: 13279 - RNA, 20 nt, Artificial Sequence
  Synthetic
uaaaaaagaacagaaugucc

SEQ ID NO: 13280 - RNA, 21 nt, Artificial Sequence
  Synthetic
guaaaaaagaacagaaugucc

SEQ ID NO: 13281 - RNA, 22 nt, Artificial Sequence
  Synthetic
uguaaaaaagaacagaaugucc

SEQ ID NO: 13282 - RNA, 23 nt, Artificial Sequence
  Synthetic
guguaaaaaagaacagaaugucc

SEQ ID NO: 13283 - RNA, 24 nt, Artificial Sequence
  Synthetic
aguguaaaaaagaacagaaugucc

SEQ ID NO: 13284 - RNA, 18 nt, Artificial Sequence
  Synthetic
aauccagcugucccuucc

SEQ ID NO: 13285 - RNA, 19 nt, Artificial Sequence
  Synthetic
aaauccagcugucccuucc

SEQ ID NO: 13286 - RNA, 20 nt, Artificial Sequence
  Synthetic
aaaauccagcugucccuucc

SEQ ID NO: 13287 - RNA, 21 nt, Artificial Sequence
  Synthetic
aaaaauccagcugucccuucc

SEQ ID NO: 13288 - RNA, 22 nt, Artificial Sequence
  Synthetic
gaaaaauccagcugucccuucc

SEQ ID NO: 13289 - RNA, 23 nt, Artificial Sequence
  Synthetic
agaaaaauccagcugucccuucc

SEQ ID NO: 13290 - RNA, 24 nt, Artificial Sequence
  Synthetic
aagaaaaauccagcugucccuucc

SEQ ID NO: 13291 - RNA, 18 nt, Artificial Sequence
  Synthetic
cccccuugcucuccuucc

SEQ ID NO: 13292 - RNA, 19 nt, Artificial Sequence
  Synthetic
ccccccuugcucuccuucc

SEQ ID NO: 13293 - RNA, 21 nt, Artificial Sequence
  Synthetic
cuccccccuugcucuccuucc

SEQ ID NO: 13294 - RNA, 22 nt, Artificial Sequence
  Synthetic
acuccccccuugcucuccuucc

SEQ ID NO: 13295 - RNA, 23 nt, Artificial Sequence
  Synthetic
gacuccccccuugcucuccuucc

SEQ ID NO: 13296 - RNA, 24 nt, Artificial Sequence
  Synthetic
ggacuccccccuugcucuccuucc

SEQ ID NO: 13297 - RNA, 18 nt, Artificial Sequence
  Synthetic
aaccugggagugggaagc

SEQ ID NO: 13298 - RNA, 19 nt, Artificial Sequence
  Synthetic
caaccugggagugggaagc

SEQ ID NO: 13299 - RNA, 21 nt, Artificial Sequence
  Synthetic
cgcaaccugggagugggaagc

SEQ ID NO: 13300 - RNA, 22 nt, Artificial Sequence
  Synthetic
ccgcaaccugggagugggaagc

SEQ ID NO: 13301 - RNA, 23 nt, Artificial Sequence
  Synthetic
gccgcaaccugggagugggaagc

SEQ ID NO: 13302 - RNA, 24 nt, Artificial Sequence
  Synthetic
agccgcaaccugggagugggaagc

SEQ ID NO: 13303 - RNA, 18 nt, Artificial Sequence
  Synthetic
acagaaucaggacacagc

SEQ ID NO: 13304 - RNA, 19 nt, Artificial Sequence
  Synthetic
gacagaaucaggacacagc

SEQ ID NO: 13305 - RNA, 20 nt, Artificial Sequence
  Synthetic
agacagaaucaggacacagc

SEQ ID NO: 13306 - RNA, 21 nt, Artificial Sequence
  Synthetic
gagacagaaucaggacacagc

SEQ ID NO: 13307 - RNA, 22 nt, Artificial Sequence
  Synthetic
agagacagaaucaggacacagc

SEQ ID NO: 13308 - RNA, 23 nt, Artificial Sequence
  Synthetic
cagagacagaaucaggacacagc

SEQ ID NO: 13309 - RNA, 24 nt, Artificial Sequence
  Synthetic
gcagagacagaaucaggacacagc

SEQ ID NO: 13310 - RNA, 18 nt, Artificial Sequence
  Synthetic
caacucugugaccacagc

SEQ ID NO: 13311 - RNA, 19 nt, Artificial Sequence
  Synthetic
gcaacucugugaccacagc

SEQ ID NO: 13312 - RNA, 21 nt, Artificial Sequence
  Synthetic
cugcaacucugugaccacagc

SEQ ID NO: 13313 - RNA, 22 nt, Artificial Sequence
  Synthetic
ccugcaacucugugaccacagc

SEQ ID NO: 13314 - RNA, 23 nt, Artificial Sequence
  Synthetic
uccugcaacucugugaccacagc

SEQ ID NO: 13315 - RNA, 24 nt, Artificial Sequence
  Synthetic
uuccugcaacucugugaccacagc

SEQ ID NO: 13316 - RNA, 18 nt, Artificial Sequence
  Synthetic
ggguggcgaggaaucagc

SEQ ID NO: 13317 - RNA, 19 nt, Artificial Sequence
  Synthetic
gggguggcgaggaaucagc

SEQ ID NO: 13318 - RNA, 21 nt, Artificial Sequence
  Synthetic
aggggguggcgaggaaucagc

SEQ ID NO: 13319 - RNA, 22 nt, Artificial Sequence
  Synthetic
gaggggguggcgaggaaucagc

SEQ ID NO: 13320 - RNA, 23 nt, Artificial Sequence
  Synthetic
ggaggggguggcgaggaaucagc

SEQ ID NO: 13321 - RNA, 24 nt, Artificial Sequence
  Synthetic
uggaggggguggcgaggaaucagc

SEQ ID NO: 13322 - RNA, 18 nt, Artificial Sequence
  Synthetic
ggccagaaagaggagagc

SEQ ID NO: 13323 - RNA, 19 nt, Artificial Sequence
  Synthetic
aggccagaaagaggagagc

SEQ ID NO: 13324 - RNA, 21 nt, Artificial Sequence
  Synthetic
gcaggccagaaagaggagagc

SEQ ID NO: 13325 - RNA, 22 nt, Artificial Sequence
  Synthetic
ggcaggccagaaagaggagagc

SEQ ID NO: 13326 - RNA, 23 nt, Artificial Sequence
  Synthetic
aggcaggccagaaagaggagagc

SEQ ID NO: 13327 - RNA, 24 nt, Artificial Sequence
  Synthetic
gaggcaggccagaaagaggagagc

SEQ ID NO: 13328 - RNA, 18 nt, Artificial Sequence
  Synthetic
ccagguuggacccugagc

SEQ ID NO: 13329 - RNA, 19 nt, Artificial Sequence
  Synthetic
accagguuggacccugagc

SEQ ID NO: 13330 - RNA, 20 nt, Artificial Sequence
  Synthetic
gaccagguuggacccugagc

SEQ ID NO: 13331 - RNA, 21 nt, Artificial Sequence
  Synthetic
agaccagguuggacccugagc

SEQ ID NO: 13332 - RNA, 22 nt, Artificial Sequence
  Synthetic
cagaccagguuggacccugagc

SEQ ID NO: 13333 - RNA, 23 nt, Artificial Sequence
  Synthetic
acagaccagguuggacccugagc

SEQ ID NO: 13334 - RNA, 24 nt, Artificial Sequence
  Synthetic
cacagaccagguuggacccugagc

SEQ ID NO: 13335 - RNA, 18 nt, Artificial Sequence
  Synthetic
ugcucccacuuagugagc

SEQ ID NO: 13336 - RNA, 19 nt, Artificial Sequence
  Synthetic
cugcucccacuuagugagc

SEQ ID NO: 13337 - RNA, 21 nt, Artificial Sequence
  Synthetic
cgcugcucccacuuagugagc

SEQ ID NO: 13338 - RNA, 22 nt, Artificial Sequence
  Synthetic
gcgcugcucccacuuagugagc

SEQ ID NO: 13339 - RNA, 23 nt, Artificial Sequence
  Synthetic
ugcgcugcucccacuuagugagc

SEQ ID NO: 13340 - RNA, 24 nt, Artificial Sequence
  Synthetic
gugcgcugcucccacuuagugagc

SEQ ID NO: 13341 - RNA, 18 nt, Artificial Sequence
  Synthetic
gucgcaagagacugccgc

SEQ ID NO: 13342 - RNA, 19 nt, Artificial Sequence
  Synthetic
agucgcaagagacugccgc

SEQ ID NO: 13343 - RNA, 20 nt, Artificial Sequence
  Synthetic
aagucgcaagagacugccgc

SEQ ID NO: 13344 - RNA, 21 nt, Artificial Sequence
  Synthetic
gaagucgcaagagacugccgc

SEQ ID NO: 13345 - RNA, 22 nt, Artificial Sequence
  Synthetic
agaagucgcaagagacugccgc

SEQ ID NO: 13346 - RNA, 23 nt, Artificial Sequence
  Synthetic
aagaagucgcaagagacugccgc

SEQ ID NO: 13347 - RNA, 24 nt, Artificial Sequence
  Synthetic
uaagaagucgcaagagacugccgc

SEQ ID NO: 13348 - RNA, 18 nt, Artificial Sequence
  Synthetic
uucacuuuaagaagucgc

SEQ ID NO: 13349 - RNA, 19 nt, Artificial Sequence
  Synthetic
uuucacuuuaagaagucgc

SEQ ID NO: 13350 - RNA, 20 nt, Artificial Sequence
  Synthetic
cuuucacuuuaagaagucgc

SEQ ID NO: 13351 - RNA, 21 nt, Artificial Sequence
  Synthetic
gcuuucacuuuaagaagucgc

SEQ ID NO: 13352 - RNA, 22 nt, Artificial Sequence
  Synthetic
ggcuuucacuuuaagaagucgc

SEQ ID NO: 13353 - RNA, 23 nt, Artificial Sequence
  Synthetic
cggcuuucacuuuaagaagucgc

SEQ ID NO: 13354 - RNA, 24 nt, Artificial Sequence
  Synthetic
ccggcuuucacuuuaagaagucgc

SEQ ID NO: 13355 - RNA, 18 nt, Artificial Sequence
  Synthetic
cuggcaaauagaaaaggc

SEQ ID NO: 13356 - RNA, 19 nt, Artificial Sequence
  Synthetic
gcuggcaaauagaaaaggc

SEQ ID NO: 13357 - RNA, 21 nt, Artificial Sequence
  Synthetic
gagcuggcaaauagaaaaggc

SEQ ID NO: 13358 - RNA, 22 nt, Artificial Sequence
  Synthetic
ugagcuggcaaauagaaaaggc

SEQ ID NO: 13359 - RNA, 23 nt, Artificial Sequence
  Synthetic
augagcuggcaaauagaaaaggc

SEQ ID NO: 13360 - RNA, 24 nt, Artificial Sequence
  Synthetic
caugagcuggcaaauagaaaaggc

SEQ ID NO: 13361 - RNA, 18 nt, Artificial Sequence
  Synthetic
agugagagggggcaaggc

SEQ ID NO: 13362 - RNA, 19 nt, Artificial Sequence
  Synthetic
gagugagagggggcaaggc

SEQ ID NO: 13363 - RNA, 20 nt, Artificial Sequence
  Synthetic
agagugagagggggcaaggc

SEQ ID NO: 13364 - RNA, 21 nt, Artificial Sequence
  Synthetic
uagagugagagggggcaaggc

SEQ ID NO: 13365 - RNA, 22 nt, Artificial Sequence
  Synthetic
cuagagugagagggggcaaggc

SEQ ID NO: 13366 - RNA, 23 nt, Artificial Sequence
  Synthetic
ccuagagugagagggggcaaggc

SEQ ID NO: 13367 - RNA, 24 nt, Artificial Sequence
  Synthetic
gccuagagugagagggggcaaggc

SEQ ID NO: 13368 - RNA, 18 nt, Artificial Sequence
  Synthetic
uagagagaggaggcaggc

SEQ ID NO: 13369 - RNA, 19 nt, Artificial Sequence
  Synthetic
uuagagagaggaggcaggc

SEQ ID NO: 13370 - RNA, 20 nt, Artificial Sequence
  Synthetic
auuagagagaggaggcaggc

SEQ ID NO: 13371 - RNA, 21 nt, Artificial Sequence
  Synthetic
gauuagagagaggaggcaggc

SEQ ID NO: 13372 - RNA, 22 nt, Artificial Sequence
  Synthetic
ggauuagagagaggaggcaggc

SEQ ID NO: 13373 - RNA, 23 nt, Artificial Sequence
  Synthetic
aggauuagagagaggaggcaggc

SEQ ID NO: 13374 - RNA, 24 nt, Artificial Sequence
  Synthetic
caggauuagagagaggaggcaggc

SEQ ID NO: 13375 - RNA, 18 nt, Artificial Sequence
  Synthetic
agugguuggauuucaggc

SEQ ID NO: 13376 - RNA, 19 nt, Artificial Sequence
  Synthetic
uagugguuggauuucaggc

SEQ ID NO: 13377 - RNA, 20 nt, Artificial Sequence
  Synthetic
cuagugguuggauuucaggc

SEQ ID NO: 13378 - RNA, 21 nt, Artificial Sequence
  Synthetic
gcuagugguuggauuucaggc

SEQ ID NO: 13379 - RNA, 22 nt, Artificial Sequence
  Synthetic
agcuagugguuggauuucaggc

SEQ ID NO: 13380 - RNA, 23 nt, Artificial Sequence
  Synthetic
aagcuagugguuggauuucaggc

SEQ ID NO: 13381 - RNA, 24 nt, Artificial Sequence
  Synthetic
uaagcuagugguuggauuucaggc

SEQ ID NO: 13382 - RNA, 18 nt, Artificial Sequence
  Synthetic
gaggucagggccagaggc

SEQ ID NO: 13383 - RNA, 19 nt, Artificial Sequence
  Synthetic
cgaggucagggccagaggc

SEQ ID NO: 13384 - RNA, 21 nt, Artificial Sequence
  Synthetic
cucgaggucagggccagaggc

SEQ ID NO: 13385 - RNA, 22 nt, Artificial Sequence
  Synthetic
gcucgaggucagggccagaggc

SEQ ID NO: 13386 - RNA, 23 nt, Artificial Sequence
  Synthetic
agcucgaggucagggccagaggc

SEQ ID NO: 13387 - RNA, 24 nt, Artificial Sequence
  Synthetic
cagcucgaggucagggccagaggc

SEQ ID NO: 13388 - RNA, 18 nt, Artificial Sequence
  Synthetic
agagagggagugagaggc

SEQ ID NO: 13389 - RNA, 19 nt, Artificial Sequence
  Synthetic
uagagagggagugagaggc

SEQ ID NO: 13390 - RNA, 21 nt, Artificial Sequence
  Synthetic
gauagagagggagugagaggc

SEQ ID NO: 13391 - RNA, 22 nt, Artificial Sequence
  Synthetic
agauagagagggagugagaggc

SEQ ID NO: 13392 - RNA, 23 nt, Artificial Sequence
  Synthetic
cagauagagagggagugagaggc

SEQ ID NO: 13393 - RNA, 24 nt, Artificial Sequence
  Synthetic
gcagauagagagggagugagaggc

SEQ ID NO: 13394 - RNA, 18 nt, Artificial Sequence
  Synthetic
cucucuucucugcagggc

SEQ ID NO: 13395 - RNA, 19 nt, Artificial Sequence
  Synthetic
ucucucuucucugcagggc

SEQ ID NO: 13396 - RNA, 20 nt, Artificial Sequence
  Synthetic
uucucucuucucugcagggc

SEQ ID NO: 13397 - RNA, 21 nt, Artificial Sequence
  Synthetic
cuucucucuucucugcagggc

SEQ ID NO: 13398 - RNA, 22 nt, Artificial Sequence
  Synthetic
ucuucucucuucucugcagggc

SEQ ID NO: 13399 - RNA, 23 nt, Artificial Sequence
  Synthetic
cucuucucucuucucugcagggc

SEQ ID NO: 13400 - RNA, 24 nt, Artificial Sequence
  Synthetic
ccucuucucucuucucugcagggc

SEQ ID NO: 13401 - RNA, 18 nt, Artificial Sequence
  Synthetic
acagcucgaggucagggc

SEQ ID NO: 13402 - RNA, 19 nt, Artificial Sequence
  Synthetic
cacagcucgaggucagggc

SEQ ID NO: 13403 - RNA, 20 nt, Artificial Sequence
  Synthetic
acacagcucgaggucagggc

SEQ ID NO: 13404 - RNA, 21 nt, Artificial Sequence
  Synthetic
gacacagcucgaggucagggc

SEQ ID NO: 13405 - RNA, 22 nt, Artificial Sequence
  Synthetic
ggacacagcucgaggucagggc

SEQ ID NO: 13406 - RNA, 23 nt, Artificial Sequence
  Synthetic
aggacacagcucgaggucagggc

SEQ ID NO: 13407 - RNA, 24 nt, Artificial Sequence
  Synthetic
caggacacagcucgaggucagggc

SEQ ID NO: 13408 - RNA, 18 nt, Artificial Sequence
  Synthetic
aagguuggaggggguggc

SEQ ID NO: 13409 - RNA, 19 nt, Artificial Sequence
  Synthetic
caagguuggaggggguggc

SEQ ID NO: 13410 - RNA, 20 nt, Artificial Sequence
  Synthetic
acaagguuggaggggguggc

SEQ ID NO: 13411 - RNA, 21 nt, Artificial Sequence
  Synthetic
gacaagguuggaggggguggc

SEQ ID NO: 13412 - RNA, 22 nt, Artificial Sequence
  Synthetic
ggacaagguuggaggggguggc

SEQ ID NO: 13413 - RNA, 23 nt, Artificial Sequence
  Synthetic
uggacaagguuggaggggguggc

SEQ ID NO: 13414 - RNA, 24 nt, Artificial Sequence
  Synthetic
cuggacaagguuggaggggguggc

SEQ ID NO: 13415 - RNA, 18 nt, Artificial Sequence
  Synthetic
agacagaaagggaggugc

SEQ ID NO: 13416 - RNA, 19 nt, Artificial Sequence
  Synthetic
gagacagaaagggaggugc

SEQ ID NO: 13417 - RNA, 20 nt, Artificial Sequence
  Synthetic
agagacagaaagggaggugc

SEQ ID NO: 13418 - RNA, 21 nt, Artificial Sequence
  Synthetic
cagagacagaaagggaggugc

SEQ ID NO: 13419 - RNA, 22 nt, Artificial Sequence
  Synthetic
gcagagacagaaagggaggugc

SEQ ID NO: 13420 - RNA, 23 nt, Artificial Sequence
  Synthetic
ggcagagacagaaagggaggugc

SEQ ID NO: 13421 - RNA, 24 nt, Artificial Sequence
  Synthetic
gggcagagacagaaagggaggugc

SEQ ID NO: 13422 - RNA, 18 nt, Artificial Sequence
  Synthetic
ugcugagcaccuuauugc

SEQ ID NO: 13423 - RNA, 19 nt, Artificial Sequence
  Synthetic
gugcugagcaccuuauugc

SEQ ID NO: 13424 - RNA, 21 nt, Artificial Sequence
  Synthetic
gggugcugagcaccuuauugc

SEQ ID NO: 13425 - RNA, 22 nt, Artificial Sequence
  Synthetic
agggugcugagcaccuuauugc

SEQ ID NO: 13426 - RNA, 23 nt, Artificial Sequence
  Synthetic
cagggugcugagcaccuuauugc

SEQ ID NO: 13427 - RNA, 24 nt, Artificial Sequence
  Synthetic
ccagggugcugagcaccuuauugc

SEQ ID NO: 13428 - RNA, 18 nt, Artificial Sequence
  Synthetic
ggagcugagacacagauc

SEQ ID NO: 13429 - RNA, 19 nt, Artificial Sequence
  Synthetic
aggagcugagacacagauc

SEQ ID NO: 13430 - RNA, 20 nt, Artificial Sequence
  Synthetic
caggagcugagacacagauc

SEQ ID NO: 13431 - RNA, 21 nt, Artificial Sequence
  Synthetic
gcaggagcugagacacagauc

SEQ ID NO: 13432 - RNA, 22 nt, Artificial Sequence
  Synthetic
ggcaggagcugagacacagauc

SEQ ID NO: 13433 - RNA, 23 nt, Artificial Sequence
  Synthetic
aggcaggagcugagacacagauc

SEQ ID NO: 13434 - RNA, 24 nt, Artificial Sequence
  Synthetic
gaggcaggagcugagacacagauc

SEQ ID NO: 13435 - RNA, 18 nt, Artificial Sequence
  Synthetic
ucgaaagguggcccuauc

SEQ ID NO: 13436 - RNA, 19 nt, Artificial Sequence
  Synthetic
cucgaaagguggcccuauc

SEQ ID NO: 13437 - RNA, 21 nt, Artificial Sequence
  Synthetic
aacucgaaagguggcccuauc

SEQ ID NO: 13438 - RNA, 22 nt, Artificial Sequence
  Synthetic
aaacucgaaagguggcccuauc

SEQ ID NO: 13439 - RNA, 23 nt, Artificial Sequence
  Synthetic
aaaacucgaaagguggcccuauc

SEQ ID NO: 13440 - RNA, 24 nt, Artificial Sequence
  Synthetic
caaaacucgaaagguggcccuauc

SEQ ID NO: 13441 - RNA, 18 nt, Artificial Sequence
  Synthetic
ggaggcagcccagaccuc

SEQ ID NO: 13442 - RNA, 19 nt, Artificial Sequence
  Synthetic
uggaggcagcccagaccuc

SEQ ID NO: 13443 - RNA, 20 nt, Artificial Sequence
  Synthetic
cuggaggcagcccagaccuc

SEQ ID NO: 13444 - RNA, 21 nt, Artificial Sequence
  Synthetic
gcuggaggcagcccagaccuc

SEQ ID NO: 13445 - RNA, 22 nt, Artificial Sequence
  Synthetic
agcuggaggcagcccagaccuc

SEQ ID NO: 13446 - RNA, 23 nt, Artificial Sequence
  Synthetic
aagcuggaggcagcccagaccuc

SEQ ID NO: 13447 - RNA, 24 nt, Artificial Sequence
  Synthetic
gaagcuggaggcagcccagaccuc

SEQ ID NO: 13448 - RNA, 18 nt, Artificial Sequence
  Synthetic
cccaguucaccugcccuc

SEQ ID NO: 13449 - RNA, 19 nt, Artificial Sequence
  Synthetic
ucccaguucaccugcccuc

SEQ ID NO: 13450 - RNA, 21 nt, Artificial Sequence
  Synthetic
acucccaguucaccugcccuc

SEQ ID NO: 13451 - RNA, 22 nt, Artificial Sequence
  Synthetic
uacucccaguucaccugcccuc

SEQ ID NO: 13452 - RNA, 23 nt, Artificial Sequence
  Synthetic
guacucccaguucaccugcccuc

SEQ ID NO: 13453 - RNA, 24 nt, Artificial Sequence
  Synthetic
aguacucccaguucaccugcccuc

SEQ ID NO: 13454 - RNA, 18 nt, Artificial Sequence
  Synthetic
uugcugagccucuagcuc

SEQ ID NO: 13455 - RNA, 19 nt, Artificial Sequence
  Synthetic
cuugcugagccucuagcuc

SEQ ID NO: 13456 - RNA, 20 nt, Artificial Sequence
  Synthetic
acuugcugagccucuagcuc

SEQ ID NO: 13457 - RNA, 21 nt, Artificial Sequence
  Synthetic
cacuugcugagccucuagcuc

SEQ ID NO: 13458 - RNA, 22 nt, Artificial Sequence
  Synthetic
ccacuugcugagccucuagcuc

SEQ ID NO: 13459 - RNA, 23 nt, Artificial Sequence
  Synthetic
cccacuugcugagccucuagcuc

SEQ ID NO: 13460 - RNA, 24 nt, Artificial Sequence
  Synthetic
gcccacuugcugagccucuagcuc

SEQ ID NO: 13461 - RNA, 18 nt, Artificial Sequence
  Synthetic
aauguaaggaccuggcuc

SEQ ID NO: 13462 - RNA, 19 nt, Artificial Sequence
  Synthetic
caauguaaggaccuggcuc

SEQ ID NO: 13463 - RNA, 20 nt, Artificial Sequence
  Synthetic
ccaauguaaggaccuggcuc

SEQ ID NO: 13464 - RNA, 21 nt, Artificial Sequence
  Synthetic
cccaauguaaggaccuggcuc

SEQ ID NO: 13465 - RNA, 22 nt, Artificial Sequence
  Synthetic
gcccaauguaaggaccuggcuc

SEQ ID NO: 13466 - RNA, 23 nt, Artificial Sequence
  Synthetic
ugcccaauguaaggaccuggcuc

SEQ ID NO: 13467 - RNA, 24 nt, Artificial Sequence
  Synthetic
augcccaauguaaggaccuggcuc

SEQ ID NO: 13468 - RNA, 18 nt, Artificial Sequence
  Synthetic
ccgcaggucugcuggcuc

SEQ ID NO: 13469 - RNA, 19 nt, Artificial Sequence
  Synthetic
cccgcaggucugcuggcuc

SEQ ID NO: 13470 - RNA, 20 nt, Artificial Sequence
  Synthetic
ucccgcaggucugcuggcuc

SEQ ID NO: 13471 - RNA, 21 nt, Artificial Sequence
  Synthetic
cucccgcaggucugcuggcuc

SEQ ID NO: 13472 - RNA, 22 nt, Artificial Sequence
  Synthetic
acucccgcaggucugcuggcuc

SEQ ID NO: 13473 - RNA, 23 nt, Artificial Sequence
  Synthetic
aacucccgcaggucugcuggcuc

SEQ ID NO: 13474 - RNA, 24 nt, Artificial Sequence
  Synthetic
caacucccgcaggucugcuggcuc

SEQ ID NO: 13475 - RNA, 18 nt, Artificial Sequence
  Synthetic
cccccaugagucugucuc

SEQ ID NO: 13476 - RNA, 19 nt, Artificial Sequence
  Synthetic
ucccccaugagucugucuc

SEQ ID NO: 13477 - RNA, 21 nt, Artificial Sequence
  Synthetic
gaucccccaugagucugucuc

SEQ ID NO: 13478 - RNA, 22 nt, Artificial Sequence
  Synthetic
cgaucccccaugagucugucuc

SEQ ID NO: 13479 - RNA, 23 nt, Artificial Sequence
  Synthetic
ccgaucccccaugagucugucuc

SEQ ID NO: 13480 - RNA, 24 nt, Artificial Sequence
  Synthetic
cccgaucccccaugagucugucuc

SEQ ID NO: 13481 - RNA, 18 nt, Artificial Sequence
  Synthetic
cagagaugacaccuucuc

SEQ ID NO: 13482 - RNA, 19 nt, Artificial Sequence
  Synthetic
gcagagaugacaccuucuc

SEQ ID NO: 13483 - RNA, 21 nt, Artificial Sequence
  Synthetic
cagcagagaugacaccuucuc

SEQ ID NO: 13484 - RNA, 22 nt, Artificial Sequence
  Synthetic
ucagcagagaugacaccuucuc

SEQ ID NO: 13485 - RNA, 23 nt, Artificial Sequence
  Synthetic
uucagcagagaugacaccuucuc

SEQ ID NO: 13486 - RNA, 24 nt, Artificial Sequence
  Synthetic
auucagcagagaugacaccuucuc

SEQ ID NO: 13487 - RNA, 18 nt, Artificial Sequence
  Synthetic
uccuggagcccugcaguc

SEQ ID NO: 13488 - RNA, 19 nt, Artificial Sequence
  Synthetic
cuccuggagcccugcaguc

SEQ ID NO: 13489 - RNA, 20 nt, Artificial Sequence
  Synthetic
ccuccuggagcccugcaguc

SEQ ID NO: 13490 - RNA, 21 nt, Artificial Sequence
  Synthetic
accuccuggagcccugcaguc

SEQ ID NO: 13491 - RNA, 22 nt, Artificial Sequence
  Synthetic
gaccuccuggagcccugcaguc

SEQ ID NO: 13492 - RNA, 23 nt, Artificial Sequence
  Synthetic
agaccuccuggagcccugcaguc

SEQ ID NO: 13493 - RNA, 24 nt, Artificial Sequence
  Synthetic
cagaccuccuggagcccugcaguc

SEQ ID NO: 13494 - RNA, 18 nt, Artificial Sequence
  Synthetic
ccccccuugcucuccuuc

SEQ ID NO: 13495 - RNA, 19 nt, Artificial Sequence
  Synthetic
uccccccuugcucuccuuc

SEQ ID NO: 13496 - RNA, 20 nt, Artificial Sequence
  Synthetic
cuccccccuugcucuccuuc

SEQ ID NO: 13497 - RNA, 21 nt, Artificial Sequence
  Synthetic
acuccccccuugcucuccuuc

SEQ ID NO: 13498 - RNA, 22 nt, Artificial Sequence
  Synthetic
gacuccccccuugcucuccuuc

SEQ ID NO: 13499 - RNA, 23 nt, Artificial Sequence
  Synthetic
ggacuccccccuugcucuccuuc

SEQ ID NO: 13500 - RNA, 24 nt, Artificial Sequence
  Synthetic
gggacuccccccuugcucuccuuc

SEQ ID NO: 13501 - RNA, 18 nt, Artificial Sequence
  Synthetic
ugcuuucccugccucuuc

SEQ ID NO: 13502 - RNA, 19 nt, Artificial Sequence
  Synthetic
cugcuuucccugccucuuc

SEQ ID NO: 13503 - RNA, 20 nt, Artificial Sequence
  Synthetic
ccugcuuucccugccucuuc

SEQ ID NO: 13504 - RNA, 21 nt, Artificial Sequence
  Synthetic
gccugcuuucccugccucuuc

SEQ ID NO: 13505 - RNA, 22 nt, Artificial Sequence
  Synthetic
ugccugcuuucccugccucuuc

SEQ ID NO: 13506 - RNA, 23 nt, Artificial Sequence
  Synthetic
gugccugcuuucccugccucuuc

SEQ ID NO: 13507 - RNA, 24 nt, Artificial Sequence
  Synthetic
agugccugcuuucccugccucuuc

SEQ ID NO: 13508 - RNA, 18 nt, Artificial Sequence
  Synthetic
gcagaggagaggccguuc

SEQ ID NO: 13509 - RNA, 19 nt, Artificial Sequence
  Synthetic
agcagaggagaggccguuc

SEQ ID NO: 13510 - RNA, 20 nt, Artificial Sequence
  Synthetic
aagcagaggagaggccguuc

SEQ ID NO: 13511 - RNA, 21 nt, Artificial Sequence
  Synthetic
gaagcagaggagaggccguuc

SEQ ID NO: 13512 - RNA, 22 nt, Artificial Sequence
  Synthetic
ggaagcagaggagaggccguuc

SEQ ID NO: 13513 - RNA, 23 nt, Artificial Sequence
  Synthetic
gggaagcagaggagaggccguuc

SEQ ID NO: 13514 - RNA, 24 nt, Artificial Sequence
  Synthetic
agggaagcagaggagaggccguuc

SEQ ID NO: 13515 - RNA, 18 nt, Artificial Sequence
  Synthetic
aagggagacuggaguuuc

SEQ ID NO: 13516 - RNA, 19 nt, Artificial Sequence
  Synthetic
caagggagacuggaguuuc

SEQ ID NO: 13517 - RNA, 20 nt, Artificial Sequence
  Synthetic
ucaagggagacuggaguuuc

SEQ ID NO: 13518 - RNA, 21 nt, Artificial Sequence
  Synthetic
cucaagggagacuggaguuuc

SEQ ID NO: 13519 - RNA, 22 nt, Artificial Sequence
  Synthetic
gcucaagggagacuggaguuuc

SEQ ID NO: 13520 - RNA, 23 nt, Artificial Sequence
  Synthetic
ggcucaagggagacuggaguuuc

SEQ ID NO: 13521 - RNA, 24 nt, Artificial Sequence
  Synthetic
uggcucaagggagacuggaguuuc

SEQ ID NO: 13522 - RNA, 18 nt, Artificial Sequence
  Synthetic
aggaggcaggccagaaag

SEQ ID NO: 13523 - RNA, 19 nt, Artificial Sequence
  Synthetic
gaggaggcaggccagaaag

SEQ ID NO: 13524 - RNA, 21 nt, Artificial Sequence
  Synthetic
gagaggaggcaggccagaaag

SEQ ID NO: 13525 - RNA, 22 nt, Artificial Sequence
  Synthetic
agagaggaggcaggccagaaag

SEQ ID NO: 13526 - RNA, 23 nt, Artificial Sequence
  Synthetic
gagagaggaggcaggccagaaag

SEQ ID NO: 13527 - RNA, 24 nt, Artificial Sequence
  Synthetic
agagagaggaggcaggccagaaag

SEQ ID NO: 13528 - RNA, 18 nt, Artificial Sequence
  Synthetic
cugcuggcuccaggaaag

SEQ ID NO: 13529 - RNA, 19 nt, Artificial Sequence
  Synthetic
ucugcuggcuccaggaaag

SEQ ID NO: 13530 - RNA, 20 nt, Artificial Sequence
  Synthetic
gucugcuggcuccaggaaag

SEQ ID NO: 13531 - RNA, 21 nt, Artificial Sequence
  Synthetic
ggucugcuggcuccaggaaag

SEQ ID NO: 13532 - RNA, 22 nt, Artificial Sequence
  Synthetic
aggucugcuggcuccaggaaag

SEQ ID NO: 13533 - RNA, 23 nt, Artificial Sequence
  Synthetic
caggucugcuggcuccaggaaag

SEQ ID NO: 13534 - RNA, 24 nt, Artificial Sequence
  Synthetic
gcaggucugcuggcuccaggaaag

SEQ ID NO: 13535 - RNA, 18 nt, Artificial Sequence
  Synthetic
gaggaaucagcaggaaag

SEQ ID NO: 13536 - RNA, 19 nt, Artificial Sequence
  Synthetic
cgaggaaucagcaggaaag

SEQ ID NO: 13537 - RNA, 21 nt, Artificial Sequence
  Synthetic
ggcgaggaaucagcaggaaag

SEQ ID NO: 13538 - RNA, 22 nt, Artificial Sequence
  Synthetic
uggcgaggaaucagcaggaaag

SEQ ID NO: 13539 - RNA, 23 nt, Artificial Sequence
  Synthetic
guggcgaggaaucagcaggaaag

SEQ ID NO: 13540 - RNA, 24 nt, Artificial Sequence
  Synthetic
gguggcgaggaaucagcaggaaag

SEQ ID NO: 13541 - RNA, 21 nt, Artificial Sequence
  Synthetic
aauccagcugucccuuccaag

SEQ ID NO: 13542 - RNA, 22 nt, Artificial Sequence
  Synthetic
aaauccagcugucccuuccaag

SEQ ID NO: 13543 - RNA, 23 nt, Artificial Sequence
  Synthetic
aaaauccagcugucccuuccaag

SEQ ID NO: 13544 - RNA, 24 nt, Artificial Sequence
  Synthetic
aaaaauccagcugucccuuccaag

SEQ ID NO: 13545 - RNA, 18 nt, Artificial Sequence
  Synthetic
gagagggggcaaggcaag

SEQ ID NO: 13546 - RNA, 19 nt, Artificial Sequence
  Synthetic
ugagagggggcaaggcaag

SEQ ID NO: 13547 - RNA, 21 nt, Artificial Sequence
  Synthetic
agugagagggggcaaggcaag

SEQ ID NO: 13548 - RNA, 22 nt, Artificial Sequence
  Synthetic
gagugagagggggcaaggcaag

SEQ ID NO: 13549 - RNA, 23 nt, Artificial Sequence
  Synthetic
agagugagagggggcaaggcaag

SEQ ID NO: 13550 - RNA, 24 nt, Artificial Sequence
  Synthetic
uagagugagagggggcaaggcaag

SEQ ID NO: 13551 - RNA, 18 nt, Artificial Sequence
  Synthetic
guggcccuaucagggaag

SEQ ID NO: 13552 - RNA, 19 nt, Artificial Sequence
  Synthetic
gguggcccuaucagggaag

SEQ ID NO: 13553 - RNA, 20 nt, Artificial Sequence
  Synthetic
agguggcccuaucagggaag

SEQ ID NO: 13554 - RNA, 21 nt, Artificial Sequence
  Synthetic
aagguggcccuaucagggaag

SEQ ID NO: 13555 - RNA, 22 nt, Artificial Sequence
  Synthetic
aaagguggcccuaucagggaag

SEQ ID NO: 13556 - RNA, 23 nt, Artificial Sequence
  Synthetic
gaaagguggcccuaucagggaag

SEQ ID NO: 13557 - RNA, 24 nt, Artificial Sequence
  Synthetic
cgaaagguggcccuaucagggaag

SEQ ID NO: 13558 - RNA, 18 nt, Artificial Sequence
  Synthetic
caaccugggagugggaag

SEQ ID NO: 13559 - RNA, 19 nt, Artificial Sequence
  Synthetic
gcaaccugggagugggaag

SEQ ID NO: 13560 - RNA, 20 nt, Artificial Sequence
  Synthetic
cgcaaccugggagugggaag

SEQ ID NO: 13561 - RNA, 21 nt, Artificial Sequence
  Synthetic
ccgcaaccugggagugggaag

SEQ ID NO: 13562 - RNA, 22 nt, Artificial Sequence
  Synthetic
gccgcaaccugggagugggaag

SEQ ID NO: 13563 - RNA, 23 nt, Artificial Sequence
  Synthetic
agccgcaaccugggagugggaag

SEQ ID NO: 13564 - RNA, 24 nt, Artificial Sequence
  Synthetic
cagccgcaaccugggagugggaag

SEQ ID NO: 13565 - RNA, 18 nt, Artificial Sequence
  Synthetic
gcaacucugugaccacag

SEQ ID NO: 13566 - RNA, 19 nt, Artificial Sequence
  Synthetic
ugcaacucugugaccacag

SEQ ID NO: 13567 - RNA, 20 nt, Artificial Sequence
  Synthetic
cugcaacucugugaccacag

SEQ ID NO: 13568 - RNA, 21 nt, Artificial Sequence
  Synthetic
ccugcaacucugugaccacag

SEQ ID NO: 13569 - RNA, 22 nt, Artificial Sequence
  Synthetic
uccugcaacucugugaccacag

SEQ ID NO: 13570 - RNA, 23 nt, Artificial Sequence
  Synthetic
uuccugcaacucugugaccacag

SEQ ID NO: 13571 - RNA, 24 nt, Artificial Sequence
  Synthetic
auuccugcaacucugugaccacag

SEQ ID NO: 13572 - RNA, 18 nt, Artificial Sequence
  Synthetic
ggaaagaggagggaccag

SEQ ID NO: 13573 - RNA, 19 nt, Artificial Sequence
  Synthetic
aggaaagaggagggaccag

SEQ ID NO: 13574 - RNA, 20 nt, Artificial Sequence
  Synthetic
caggaaagaggagggaccag

SEQ ID NO: 13575 - RNA, 21 nt, Artificial Sequence
  Synthetic
gcaggaaagaggagggaccag

SEQ ID NO: 13576 - RNA, 22 nt, Artificial Sequence
  Synthetic
agcaggaaagaggagggaccag

SEQ ID NO: 13577 - RNA, 23 nt, Artificial Sequence
  Synthetic
cagcaggaaagaggagggaccag

SEQ ID NO: 13578 - RNA, 24 nt, Artificial Sequence
  Synthetic
ucagcaggaaagaggagggaccag

SEQ ID NO: 13579 - RNA, 18 nt, Artificial Sequence
  Synthetic
cuaaguagauagccccag

SEQ ID NO: 13580 - RNA, 19 nt, Artificial Sequence
  Synthetic
gcuaaguagauagccccag

SEQ ID NO: 13581 - RNA, 21 nt, Artificial Sequence
  Synthetic
gcgcuaaguagauagccccag

SEQ ID NO: 13582 - RNA, 22 nt, Artificial Sequence
  Synthetic
agcgcuaaguagauagccccag

SEQ ID NO: 13583 - RNA, 23 nt, Artificial Sequence
  Synthetic
aagcgcuaaguagauagccccag

SEQ ID NO: 13584 - RNA, 24 nt, Artificial Sequence
  Synthetic
aaagcgcuaaguagauagccccag

SEQ ID NO: 13585 - RNA, 18 nt, Artificial Sequence
  Synthetic
gcccuaucagggaagcag

SEQ ID NO: 13586 - RNA, 19 nt, Artificial Sequence
  Synthetic
ggcccuaucagggaagcag

SEQ ID NO: 13587 - RNA, 21 nt, Artificial Sequence
  Synthetic
guggcccuaucagggaagcag

SEQ ID NO: 13588 - RNA, 22 nt, Artificial Sequence
  Synthetic
gguggcccuaucagggaagcag

SEQ ID NO: 13589 - RNA, 23 nt, Artificial Sequence
  Synthetic
agguggcccuaucagggaagcag

SEQ ID NO: 13590 - RNA, 24 nt, Artificial Sequence
  Synthetic
aagguggcccuaucagggaagcag

SEQ ID NO: 13591 - RNA, 18 nt, Artificial Sequence
  Synthetic
ccagaaagaggagagcag

SEQ ID NO: 13592 - RNA, 19 nt, Artificial Sequence
  Synthetic
gccagaaagaggagagcag

SEQ ID NO: 13593 - RNA, 20 nt, Artificial Sequence
  Synthetic
ggccagaaagaggagagcag

SEQ ID NO: 13594 - RNA, 21 nt, Artificial Sequence
  Synthetic
aggccagaaagaggagagcag

SEQ ID NO: 13595 - RNA, 22 nt, Artificial Sequence
  Synthetic
caggccagaaagaggagagcag

SEQ ID NO: 13596 - RNA, 23 nt, Artificial Sequence
  Synthetic
gcaggccagaaagaggagagcag

SEQ ID NO: 13597 - RNA, 24 nt, Artificial Sequence
  Synthetic
ggcaggccagaaagaggagagcag

SEQ ID NO: 13598 - RNA, 18 nt, Artificial Sequence
  Synthetic
cugggauauguggggcag

SEQ ID NO: 13599 - RNA, 19 nt, Artificial Sequence
  Synthetic
ucugggauauguggggcag

SEQ ID NO: 13600 - RNA, 21 nt, Artificial Sequence
  Synthetic
ucucugggauauguggggcag

SEQ ID NO: 13601 - RNA, 22 nt, Artificial Sequence
  Synthetic
gucucugggauauguggggcag

SEQ ID NO: 13602 - RNA, 23 nt, Artificial Sequence
  Synthetic
ggucucugggauauguggggcag

SEQ ID NO: 13603 - RNA, 24 nt, Artificial Sequence
  Synthetic
gggucucugggauauguggggcag

SEQ ID NO: 13604 - RNA, 18 nt, Artificial Sequence
  Synthetic
gggguggcgaggaaucag

SEQ ID NO: 13605 - RNA, 19 nt, Artificial Sequence
  Synthetic
ggggguggcgaggaaucag

SEQ ID NO: 13606 - RNA, 20 nt, Artificial Sequence
  Synthetic
aggggguggcgaggaaucag

SEQ ID NO: 13607 - RNA, 21 nt, Artificial Sequence
  Synthetic
gaggggguggcgaggaaucag

SEQ ID NO: 13608 - RNA, 22 nt, Artificial Sequence
  Synthetic
ggaggggguggcgaggaaucag

SEQ ID NO: 13609 - RNA, 23 nt, Artificial Sequence
  Synthetic
uggaggggguggcgaggaaucag

SEQ ID NO: 13610 - RNA, 24 nt, Artificial Sequence
  Synthetic
uuggaggggguggcgaggaaucag

SEQ ID NO: 13611 - RNA, 18 nt, Artificial Sequence
  Synthetic
ggccgcugcaccugucag

SEQ ID NO: 13612 - RNA, 19 nt, Artificial Sequence
  Synthetic
aggccgcugcaccugucag

SEQ ID NO: 13613 - RNA, 20 nt, Artificial Sequence
  Synthetic
caggccgcugcaccugucag

SEQ ID NO: 13614 - RNA, 21 nt, Artificial Sequence
  Synthetic
ccaggccgcugcaccugucag

SEQ ID NO: 13615 - RNA, 22 nt, Artificial Sequence
  Synthetic
gccaggccgcugcaccugucag

SEQ ID NO: 13616 - RNA, 23 nt, Artificial Sequence
  Synthetic
agccaggccgcugcaccugucag

SEQ ID NO: 13617 - RNA, 24 nt, Artificial Sequence
  Synthetic
cagccaggccgcugcaccugucag

SEQ ID NO: 13618 - RNA, 18 nt, Artificial Sequence
  Synthetic
uugcuugucaagauucag

SEQ ID NO: 13619 - RNA, 19 nt, Artificial Sequence
  Synthetic
cuugcuugucaagauucag

SEQ ID NO: 13620 - RNA, 20 nt, Artificial Sequence
  Synthetic
ccuugcuugucaagauucag

SEQ ID NO: 13621 - RNA, 21 nt, Artificial Sequence
  Synthetic
uccuugcuugucaagauucag

SEQ ID NO: 13622 - RNA, 22 nt, Artificial Sequence
  Synthetic
cuccuugcuugucaagauucag

SEQ ID NO: 13623 - RNA, 23 nt, Artificial Sequence
  Synthetic
acuccuugcuugucaagauucag

SEQ ID NO: 13624 - RNA, 24 nt, Artificial Sequence
  Synthetic
aacuccuugcuugucaagauucag

SEQ ID NO: 13625 - RNA, 18 nt, Artificial Sequence
  Synthetic
gaggcaggccagaaagag

SEQ ID NO: 13626 - RNA, 19 nt, Artificial Sequence
  Synthetic
ggaggcaggccagaaagag

SEQ ID NO: 13627 - RNA, 20 nt, Artificial Sequence
  Synthetic
aggaggcaggccagaaagag

SEQ ID NO: 13628 - RNA, 21 nt, Artificial Sequence
  Synthetic
gaggaggcaggccagaaagag

SEQ ID NO: 13629 - RNA, 22 nt, Artificial Sequence
  Synthetic
agaggaggcaggccagaaagag

SEQ ID NO: 13630 - RNA, 23 nt, Artificial Sequence
  Synthetic
gagaggaggcaggccagaaagag

SEQ ID NO: 13631 - RNA, 24 nt, Artificial Sequence
  Synthetic
agagaggaggcaggccagaaagag

SEQ ID NO: 13632 - RNA, 18 nt, Artificial Sequence
  Synthetic
ggaaucagcaggaaagag

SEQ ID NO: 13633 - RNA, 19 nt, Artificial Sequence
  Synthetic
aggaaucagcaggaaagag

SEQ ID NO: 13634 - RNA, 20 nt, Artificial Sequence
  Synthetic
gaggaaucagcaggaaagag

SEQ ID NO: 13635 - RNA, 21 nt, Artificial Sequence
  Synthetic
cgaggaaucagcaggaaagag

SEQ ID NO: 13636 - RNA, 22 nt, Artificial Sequence
  Synthetic
gcgaggaaucagcaggaaagag

SEQ ID NO: 13637 - RNA, 23 nt, Artificial Sequence
  Synthetic
ggcgaggaaucagcaggaaagag

SEQ ID NO: 13638 - RNA, 24 nt, Artificial Sequence
  Synthetic
uggcgaggaaucagcaggaaagag

SEQ ID NO: 13639 - RNA, 18 nt, Artificial Sequence
  Synthetic
aagagacugccgcaagag

SEQ ID NO: 13640 - RNA, 19 nt, Artificial Sequence
  Synthetic
caagagacugccgcaagag

SEQ ID NO: 13641 - RNA, 21 nt, Artificial Sequence
  Synthetic
cgcaagagacugccgcaagag

SEQ ID NO: 13642 - RNA, 22 nt, Artificial Sequence
  Synthetic
ucgcaagagacugccgcaagag

SEQ ID NO: 13643 - RNA, 23 nt, Artificial Sequence
  Synthetic
gucgcaagagacugccgcaagag

SEQ ID NO: 13644 - RNA, 24 nt, Artificial Sequence
  Synthetic
agucgcaagagacugccgcaagag

SEQ ID NO: 13645 - RNA, 18 nt, Artificial Sequence
  Synthetic
aaguagauagccccagag

SEQ ID NO: 13646 - RNA, 19 nt, Artificial Sequence
  Synthetic
uaaguagauagccccagag

SEQ ID NO: 13647 - RNA, 20 nt, Artificial Sequence
  Synthetic
cuaaguagauagccccagag

SEQ ID NO: 13648 - RNA, 21 nt, Artificial Sequence
  Synthetic
gcuaaguagauagccccagag

SEQ ID NO: 13649 - RNA, 22 nt, Artificial Sequence
  Synthetic
cgcuaaguagauagccccagag

SEQ ID NO: 13650 - RNA, 23 nt, Artificial Sequence
  Synthetic
gcgcuaaguagauagccccagag

SEQ ID NO: 13651 - RNA, 24 nt, Artificial Sequence
  Synthetic
agcgcuaaguagauagccccagag

SEQ ID NO: 13652 - RNA, 18 nt, Artificial Sequence
  Synthetic
ccuaucagggaagcagag

SEQ ID NO: 13653 - RNA, 19 nt, Artificial Sequence
  Synthetic
cccuaucagggaagcagag

SEQ ID NO: 13654 - RNA, 20 nt, Artificial Sequence
  Synthetic
gcccuaucagggaagcagag

SEQ ID NO: 13655 - RNA, 21 nt, Artificial Sequence
  Synthetic
ggcccuaucagggaagcagag

SEQ ID NO: 13656 - RNA, 22 nt, Artificial Sequence
  Synthetic
uggcccuaucagggaagcagag

SEQ ID NO: 13657 - RNA, 23 nt, Artificial Sequence
  Synthetic
guggcccuaucagggaagcagag

SEQ ID NO: 13658 - RNA, 24 nt, Artificial Sequence
  Synthetic
gguggcccuaucagggaagcagag

SEQ ID NO: 13659 - RNA, 18 nt, Artificial Sequence
  Synthetic
agaggcaggauuagagag

SEQ ID NO: 13660 - RNA, 19 nt, Artificial Sequence
  Synthetic
gagaggcaggauuagagag

SEQ ID NO: 13661 - RNA, 21 nt, Artificial Sequence
  Synthetic
aagagaggcaggauuagagag

SEQ ID NO: 13662 - RNA, 22 nt, Artificial Sequence
  Synthetic
gaagagaggcaggauuagagag

SEQ ID NO: 13663 - RNA, 23 nt, Artificial Sequence
  Synthetic
ggaagagaggcaggauuagagag

SEQ ID NO: 13664 - RNA, 24 nt, Artificial Sequence
  Synthetic
aggaagagaggcaggauuagagag

SEQ ID NO: 13665 - RNA, 18 nt, Artificial Sequence
  Synthetic
aggccagaaagaggagag

SEQ ID NO: 13666 - RNA, 19 nt, Artificial Sequence
  Synthetic
caggccagaaagaggagag

SEQ ID NO: 13667 - RNA, 20 nt, Artificial Sequence
  Synthetic
gcaggccagaaagaggagag

SEQ ID NO: 13668 - RNA, 21 nt, Artificial Sequence
  Synthetic
ggcaggccagaaagaggagag

SEQ ID NO: 13669 - RNA, 22 nt, Artificial Sequence
  Synthetic
aggcaggccagaaagaggagag

SEQ ID NO: 13670 - RNA, 23 nt, Artificial Sequence
  Synthetic
gaggcaggccagaaagaggagag

SEQ ID NO: 13671 - RNA, 24 nt, Artificial Sequence
  Synthetic
ggaggcaggccagaaagaggagag

SEQ ID NO: 13672 - RNA, 18 nt, Artificial Sequence
  Synthetic
aacagaaggcagauagag

SEQ ID NO: 13673 - RNA, 19 nt, Artificial Sequence
  Synthetic
aaacagaaggcagauagag

SEQ ID NO: 13674 - RNA, 21 nt, Artificial Sequence
  Synthetic
agaaacagaaggcagauagag

SEQ ID NO: 13675 - RNA, 22 nt, Artificial Sequence
  Synthetic
gagaaacagaaggcagauagag

SEQ ID NO: 13676 - RNA, 23 nt, Artificial Sequence
  Synthetic
agagaaacagaaggcagauagag

SEQ ID NO: 13677 - RNA, 24 nt, Artificial Sequence
  Synthetic
aagagaaacagaaggcagauagag

SEQ ID NO: 13678 - RNA, 18 nt, Artificial Sequence
  Synthetic
gggagugagaggcaggag

SEQ ID NO: 13679 - RNA, 19 nt, Artificial Sequence
  Synthetic
agggagugagaggcaggag

SEQ ID NO: 13680 - RNA, 20 nt, Artificial Sequence
  Synthetic
gagggagugagaggcaggag

SEQ ID NO: 13681 - RNA, 21 nt, Artificial Sequence
  Synthetic
agagggagugagaggcaggag

SEQ ID NO: 13682 - RNA, 22 nt, Artificial Sequence
  Synthetic
gagagggagugagaggcaggag

SEQ ID NO: 13683 - RNA, 23 nt, Artificial Sequence
  Synthetic
agagagggagugagaggcaggag

SEQ ID NO: 13684 - RNA, 24 nt, Artificial Sequence
  Synthetic
uagagagggagugagaggcaggag

SEQ ID NO: 13685 - RNA, 18 nt, Artificial Sequence
  Synthetic
uagauagccccagaggag

SEQ ID NO: 13686 - RNA, 19 nt, Artificial Sequence
  Synthetic
guagauagccccagaggag

SEQ ID NO: 13687 - RNA, 20 nt, Artificial Sequence
  Synthetic
aguagauagccccagaggag

SEQ ID NO: 13688 - RNA, 21 nt, Artificial Sequence
  Synthetic
aaguagauagccccagaggag

SEQ ID NO: 13689 - RNA, 22 nt, Artificial Sequence
  Synthetic
uaaguagauagccccagaggag

SEQ ID NO: 13690 - RNA, 23 nt, Artificial Sequence
  Synthetic
cuaaguagauagccccagaggag

SEQ ID NO: 13691 - RNA, 24 nt, Artificial Sequence
  Synthetic
gcuaaguagauagccccagaggag

SEQ ID NO: 13692 - RNA, 18 nt, Artificial Sequence
  Synthetic
ggaggagggagggaggag

SEQ ID NO: 13693 - RNA, 19 nt, Artificial Sequence
  Synthetic
uggaggagggagggaggag

SEQ ID NO: 13694 - RNA, 21 nt, Artificial Sequence
  Synthetic
gguggaggagggagggaggag

SEQ ID NO: 13695 - RNA, 22 nt, Artificial Sequence
  Synthetic
agguggaggagggagggaggag

SEQ ID NO: 13696 - RNA, 23 nt, Artificial Sequence
  Synthetic
aagguggaggagggagggaggag

SEQ ID NO: 13697 - RNA, 24 nt, Artificial Sequence
  Synthetic
aaagguggaggagggagggaggag

SEQ ID NO: 13698 - RNA, 18 nt, Artificial Sequence
  Synthetic
cugucaggugagggggag

SEQ ID NO: 13699 - RNA, 19 nt, Artificial Sequence
  Synthetic
ccugucaggugagggggag

SEQ ID NO: 13700 - RNA, 20 nt, Artificial Sequence
  Synthetic
accugucaggugagggggag

SEQ ID NO: 13701 - RNA, 21 nt, Artificial Sequence
  Synthetic
caccugucaggugagggggag

SEQ ID NO: 13702 - RNA, 22 nt, Artificial Sequence
  Synthetic
gcaccugucaggugagggggag

SEQ ID NO: 13703 - RNA, 23 nt, Artificial Sequence
  Synthetic
ugcaccugucaggugagggggag

SEQ ID NO: 13704 - RNA, 24 nt, Artificial Sequence
  Synthetic
cugcaccugucaggugagggggag

SEQ ID NO: 13705 - RNA, 18 nt, Artificial Sequence
  Synthetic
gcaaggcaagggggggag

SEQ ID NO: 13706 - RNA, 19 nt, Artificial Sequence
  Synthetic
ggcaaggcaagggggggag

SEQ ID NO: 13707 - RNA, 21 nt, Artificial Sequence
  Synthetic
ggggcaaggcaagggggggag

SEQ ID NO: 13708 - RNA, 22 nt, Artificial Sequence
  Synthetic
gggggcaaggcaagggggggag

SEQ ID NO: 13709 - RNA, 23 nt, Artificial Sequence
  Synthetic
agggggcaaggcaagggggggag

SEQ ID NO: 13710 - RNA, 24 nt, Artificial Sequence
  Synthetic
gagggggcaaggcaagggggggag

SEQ ID NO: 13711 - RNA, 18 nt, Artificial Sequence
  Synthetic
ccagccgcaaccugggag

SEQ ID NO: 13712 - RNA, 19 nt, Artificial Sequence
  Synthetic
uccagccgcaaccugggag

SEQ ID NO: 13713 - RNA, 21 nt, Artificial Sequence
  Synthetic
aguccagccgcaaccugggag

SEQ ID NO: 13714 - RNA, 22 nt, Artificial Sequence
  Synthetic
caguccagccgcaaccugggag

SEQ ID NO: 13715 - RNA, 23 nt, Artificial Sequence
  Synthetic
ccaguccagccgcaaccugggag

SEQ ID NO: 13716 - RNA, 24 nt, Artificial Sequence
  Synthetic
cccaguccagccgcaaccugggag

SEQ ID NO: 13717 - RNA, 18 nt, Artificial Sequence
  Synthetic
cagggccagaggcuggag

SEQ ID NO: 13718 - RNA, 19 nt, Artificial Sequence
  Synthetic
ucagggccagaggcuggag

SEQ ID NO: 13719 - RNA, 20 nt, Artificial Sequence
  Synthetic
gucagggccagaggcuggag

SEQ ID NO: 13720 - RNA, 21 nt, Artificial Sequence
  Synthetic
ggucagggccagaggcuggag

SEQ ID NO: 13721 - RNA, 22 nt, Artificial Sequence
  Synthetic
aggucagggccagaggcuggag

SEQ ID NO: 13722 - RNA, 23 nt, Artificial Sequence
  Synthetic
gaggucagggccagaggcuggag

SEQ ID NO: 13723 - RNA, 24 nt, Artificial Sequence
  Synthetic
cgaggucagggccagaggcuggag

SEQ ID NO: 13724 - RNA, 18 nt, Artificial Sequence
  Synthetic
gcuccaggaaagguggag

SEQ ID NO: 13725 - RNA, 19 nt, Artificial Sequence
  Synthetic
ggcuccaggaaagguggag

SEQ ID NO: 13726 - RNA, 20 nt, Artificial Sequence
  Synthetic
uggcuccaggaaagguggag

SEQ ID NO: 13727 - RNA, 21 nt, Artificial Sequence
  Synthetic
cuggcuccaggaaagguggag

SEQ ID NO: 13728 - RNA, 22 nt, Artificial Sequence
  Synthetic
gcuggcuccaggaaagguggag

SEQ ID NO: 13729 - RNA, 23 nt, Artificial Sequence
  Synthetic
ugcuggcuccaggaaagguggag

SEQ ID NO: 13730 - RNA, 24 nt, Artificial Sequence
  Synthetic
cugcuggcuccaggaaagguggag

SEQ ID NO: 13731 - RNA, 18 nt, Artificial Sequence
  Synthetic
cugagggccuagagugag

SEQ ID NO: 13732 - RNA, 19 nt, Artificial Sequence
  Synthetic
gcugagggccuagagugag

SEQ ID NO: 13733 - RNA, 21 nt, Artificial Sequence
  Synthetic
gagcugagggccuagagugag

SEQ ID NO: 13734 - RNA, 22 nt, Artificial Sequence
  Synthetic
ggagcugagggccuagagugag

SEQ ID NO: 13735 - RNA, 23 nt, Artificial Sequence
  Synthetic
uggagcugagggccuagagugag

SEQ ID NO: 13736 - RNA, 24 nt, Artificial Sequence
  Synthetic
cuggagcugagggccuagagugag

SEQ ID NO: 13737 - RNA, 18 nt, Artificial Sequence
  Synthetic
cugcucccacuuagugag

SEQ ID NO: 13738 - RNA, 19 nt, Artificial Sequence
  Synthetic
gcugcucccacuuagugag

SEQ ID NO: 13739 - RNA, 21 nt, Artificial Sequence
  Synthetic
gcgcugcucccacuuagugag

SEQ ID NO: 13740 - RNA, 22 nt, Artificial Sequence
  Synthetic
ugcgcugcucccacuuagugag

SEQ ID NO: 13741 - RNA, 23 nt, Artificial Sequence
  Synthetic
gugcgcugcucccacuuagugag

SEQ ID NO: 13742 - RNA, 24 nt, Artificial Sequence
  Synthetic
agugcgcugcucccacuuagugag

SEQ ID NO: 13743 - RNA, 18 nt, Artificial Sequence
  Synthetic
cugcaccugucaggugag

SEQ ID NO: 13744 - RNA, 19 nt, Artificial Sequence
  Synthetic
gcugcaccugucaggugag

SEQ ID NO: 13745 - RNA, 21 nt, Artificial Sequence
  Synthetic
ccgcugcaccugucaggugag

SEQ ID NO: 13746 - RNA, 22 nt, Artificial Sequence
  Synthetic
gccgcugcaccugucaggugag

SEQ ID NO: 13747 - RNA, 23 nt, Artificial Sequence
  Synthetic
ggccgcugcaccugucaggugag

SEQ ID NO: 13748 - RNA, 24 nt, Artificial Sequence
  Synthetic
aggccgcugcaccugucaggugag

SEQ ID NO: 13749 - RNA, 18 nt, Artificial Sequence
  Synthetic
gcucccacuuagugagcg

SEQ ID NO: 13750 - RNA, 19 nt, Artificial Sequence
  Synthetic
ugcucccacuuagugagcg

SEQ ID NO: 13751 - RNA, 21 nt, Artificial Sequence
  Synthetic
gcugcucccacuuagugagcg

SEQ ID NO: 13752 - RNA, 22 nt, Artificial Sequence
  Synthetic
cgcugcucccacuuagugagcg

SEQ ID NO: 13753 - RNA, 23 nt, Artificial Sequence
  Synthetic
gcgcugcucccacuuagugagcg

SEQ ID NO: 13754 - RNA, 24 nt, Artificial Sequence
  Synthetic
ugcgcugcucccacuuagugagcg

SEQ ID NO: 13755 - RNA, 18 nt, Artificial Sequence
  Synthetic
gcuggcaaauagaaaagg

SEQ ID NO: 13756 - RNA, 19 nt, Artificial Sequence
  Synthetic
agcuggcaaauagaaaagg

SEQ ID NO: 13757 - RNA, 20 nt, Artificial Sequence
  Synthetic
gagcuggcaaauagaaaagg

SEQ ID NO: 13758 - RNA, 21 nt, Artificial Sequence
  Synthetic
ugagcuggcaaauagaaaagg

SEQ ID NO: 13759 - RNA, 22 nt, Artificial Sequence
  Synthetic
augagcuggcaaauagaaaagg

SEQ ID NO: 13760 - RNA, 23 nt, Artificial Sequence
  Synthetic
caugagcuggcaaauagaaaagg

SEQ ID NO: 13761 - RNA, 24 nt, Artificial Sequence
  Synthetic
gcaugagcuggcaaauagaaaagg

SEQ ID NO: 13762 - RNA, 18 nt, Artificial Sequence
  Synthetic
gaggaagaagaccaaagg

SEQ ID NO: 13763 - RNA, 19 nt, Artificial Sequence
  Synthetic
ggaggaagaagaccaaagg

SEQ ID NO: 13764 - RNA, 20 nt, Artificial Sequence
  Synthetic
uggaggaagaagaccaaagg

SEQ ID NO: 13765 - RNA, 21 nt, Artificial Sequence
  Synthetic
cuggaggaagaagaccaaagg

SEQ ID NO: 13766 - RNA, 22 nt, Artificial Sequence
  Synthetic
ccuggaggaagaagaccaaagg

SEQ ID NO: 13767 - RNA, 23 nt, Artificial Sequence
  Synthetic
uccuggaggaagaagaccaaagg

SEQ ID NO: 13768 - RNA, 24 nt, Artificial Sequence
  Synthetic
auccuggaggaagaagaccaaagg

SEQ ID NO: 13769 - RNA, 18 nt, Artificial Sequence
  Synthetic
ugcuggcuccaggaaagg

SEQ ID NO: 13770 - RNA, 19 nt, Artificial Sequence
  Synthetic
cugcuggcuccaggaaagg

SEQ ID NO: 13771 - RNA, 21 nt, Artificial Sequence
  Synthetic
gucugcuggcuccaggaaagg

SEQ ID NO: 13772 - RNA, 22 nt, Artificial Sequence
  Synthetic
ggucugcuggcuccaggaaagg

SEQ ID NO: 13773 - RNA, 23 nt, Artificial Sequence
  Synthetic
aggucugcuggcuccaggaaagg

SEQ ID NO: 13774 - RNA, 24 nt, Artificial Sequence
  Synthetic
caggucugcuggcuccaggaaagg

SEQ ID NO: 13775 - RNA, 18 nt, Artificial Sequence
  Synthetic
ucccgggucuggacaagg

SEQ ID NO: 13776 - RNA, 19 nt, Artificial Sequence
  Synthetic
cucccgggucuggacaagg

SEQ ID NO: 13777 - RNA, 20 nt, Artificial Sequence
  Synthetic
ccucccgggucuggacaagg

SEQ ID NO: 13778 - RNA, 21 nt, Artificial Sequence
  Synthetic
cccucccgggucuggacaagg

SEQ ID NO: 13779 - RNA, 22 nt, Artificial Sequence
  Synthetic
ccccucccgggucuggacaagg

SEQ ID NO: 13780 - RNA, 23 nt, Artificial Sequence
  Synthetic
gccccucccgggucuggacaagg

SEQ ID NO: 13781 - RNA, 24 nt, Artificial Sequence
  Synthetic
ggccccucccgggucuggacaagg

SEQ ID NO: 13782 - RNA, 18 nt, Artificial Sequence
  Synthetic
agagggggcaaggcaagg

SEQ ID NO: 13783 - RNA, 19 nt, Artificial Sequence
  Synthetic
gagagggggcaaggcaagg

SEQ ID NO: 13784 - RNA, 21 nt, Artificial Sequence
  Synthetic
gugagagggggcaaggcaagg

SEQ ID NO: 13785 - RNA, 22 nt, Artificial Sequence
  Synthetic
agugagagggggcaaggcaagg

SEQ ID NO: 13786 - RNA, 23 nt, Artificial Sequence
  Synthetic
gagugagagggggcaaggcaagg

SEQ ID NO: 13787 - RNA, 24 nt, Artificial Sequence
  Synthetic
agagugagagggggcaaggcaagg

SEQ ID NO: 13788 - RNA, 18 nt, Artificial Sequence
  Synthetic
aggaagccacagaccagg

SEQ ID NO: 13789 - RNA, 19 nt, Artificial Sequence
  Synthetic
gaggaagccacagaccagg

SEQ ID NO: 13790 - RNA, 20 nt, Artificial Sequence
  Synthetic
agaggaagccacagaccagg

SEQ ID NO: 13791 - RNA, 21 nt, Artificial Sequence
  Synthetic
gagaggaagccacagaccagg

SEQ ID NO: 13792 - RNA, 22 nt, Artificial Sequence
  Synthetic
agagaggaagccacagaccagg

SEQ ID NO: 13793 - RNA, 23 nt, Artificial Sequence
  Synthetic
aagagaggaagccacagaccagg

SEQ ID NO: 13794 - RNA, 24 nt, Artificial Sequence
  Synthetic
caagagaggaagccacagaccagg

SEQ ID NO: 13795 - RNA, 18 nt, Artificial Sequence
  Synthetic
gaaagaggagggaccagg

SEQ ID NO: 13796 - RNA, 19 nt, Artificial Sequence
  Synthetic
ggaaagaggagggaccagg

SEQ ID NO: 13797 - RNA, 21 nt, Artificial Sequence
  Synthetic
caggaaagaggagggaccagg

SEQ ID NO: 13798 - RNA, 22 nt, Artificial Sequence
  Synthetic
gcaggaaagaggagggaccagg

SEQ ID NO: 13799 - RNA, 23 nt, Artificial Sequence
  Synthetic
agcaggaaagaggagggaccagg

SEQ ID NO: 13800 - RNA, 24 nt, Artificial Sequence
  Synthetic
cagcaggaaagaggagggaccagg

SEQ ID NO: 13801 - RNA, 21 nt, Artificial Sequence
  Synthetic
gugggagaaugugggcgcagg

SEQ ID NO: 13802 - RNA, 22 nt, Artificial Sequence
  Synthetic
agugggagaaugugggcgcagg

SEQ ID NO: 13803 - RNA, 23 nt, Artificial Sequence
  Synthetic
gagugggagaaugugggcgcagg

SEQ ID NO: 13804 - RNA, 24 nt, Artificial Sequence
  Synthetic
ggagugggagaaugugggcgcagg

SEQ ID NO: 13805 - RNA, 18 nt, Artificial Sequence
  Synthetic
ugagcaccuuauugcagg

SEQ ID NO: 13806 - RNA, 19 nt, Artificial Sequence
  Synthetic
cugagcaccuuauugcagg

SEQ ID NO: 13807 - RNA, 20 nt, Artificial Sequence
  Synthetic
gcugagcaccuuauugcagg

SEQ ID NO: 13808 - RNA, 21 nt, Artificial Sequence
  Synthetic
ugcugagcaccuuauugcagg

SEQ ID NO: 13809 - RNA, 22 nt, Artificial Sequence
  Synthetic
gugcugagcaccuuauugcagg

SEQ ID NO: 13810 - RNA, 23 nt, Artificial Sequence
  Synthetic
ggugcugagcaccuuauugcagg

SEQ ID NO: 13811 - RNA, 24 nt, Artificial Sequence
  Synthetic
gggugcugagcaccuuauugcagg

SEQ ID NO: 13812 - RNA, 18 nt, Artificial Sequence
  Synthetic
uguguaucaaugcucagg

SEQ ID NO: 13813 - RNA, 19 nt, Artificial Sequence
  Synthetic
guguguaucaaugcucagg

SEQ ID NO: 13814 - RNA, 20 nt, Artificial Sequence
  Synthetic
gguguguaucaaugcucagg

SEQ ID NO: 13815 - RNA, 21 nt, Artificial Sequence
  Synthetic
cgguguguaucaaugcucagg

SEQ ID NO: 13816 - RNA, 22 nt, Artificial Sequence
  Synthetic
ccgguguguaucaaugcucagg

SEQ ID NO: 13817 - RNA, 23 nt, Artificial Sequence
  Synthetic
cccgguguguaucaaugcucagg

SEQ ID NO: 13818 - RNA, 24 nt, Artificial Sequence
  Synthetic
ccccgguguguaucaaugcucagg

SEQ ID NO: 13819 - RNA, 18 nt, Artificial Sequence
  Synthetic
gaaucagcaggaaagagg

SEQ ID NO: 13820 - RNA, 19 nt, Artificial Sequence
  Synthetic
ggaaucagcaggaaagagg

SEQ ID NO: 13821 - RNA, 21 nt, Artificial Sequence
  Synthetic
gaggaaucagcaggaaagagg

SEQ ID NO: 13822 - RNA, 22 nt, Artificial Sequence
  Synthetic
cgaggaaucagcaggaaagagg

SEQ ID NO: 13823 - RNA, 23 nt, Artificial Sequence
  Synthetic
gcgaggaaucagcaggaaagagg

SEQ ID NO: 13824 - RNA, 24 nt, Artificial Sequence
  Synthetic
ggcgaggaaucagcaggaaagagg

SEQ ID NO: 13825 - RNA, 18 nt, Artificial Sequence
  Synthetic
aguagauagccccagagg

SEQ ID NO: 13826 - RNA, 19 nt, Artificial Sequence
  Synthetic
aaguagauagccccagagg

SEQ ID NO: 13827 - RNA, 21 nt, Artificial Sequence
  Synthetic
cuaaguagauagccccagagg

SEQ ID NO: 13828 - RNA, 22 nt, Artificial Sequence
  Synthetic
gcuaaguagauagccccagagg

SEQ ID NO: 13829 - RNA, 23 nt, Artificial Sequence
  Synthetic
cgcuaaguagauagccccagagg

SEQ ID NO: 13830 - RNA, 24 nt, Artificial Sequence
  Synthetic
gcgcuaaguagauagccccagagg

SEQ ID NO: 13831 - RNA, 18 nt, Artificial Sequence
  Synthetic
cgaggucagggccagagg

SEQ ID NO: 13832 - RNA, 19 nt, Artificial Sequence
  Synthetic
ucgaggucagggccagagg

SEQ ID NO: 13833 - RNA, 20 nt, Artificial Sequence
  Synthetic
cucgaggucagggccagagg

SEQ ID NO: 13834 - RNA, 21 nt, Artificial Sequence
  Synthetic
gcucgaggucagggccagagg

SEQ ID NO: 13835 - RNA, 22 nt, Artificial Sequence
  Synthetic
agcucgaggucagggccagagg

SEQ ID NO: 13836 - RNA, 23 nt, Artificial Sequence
  Synthetic
cagcucgaggucagggccagagg

SEQ ID NO: 13837 - RNA, 24 nt, Artificial Sequence
  Synthetic
acagcucgaggucagggccagagg

SEQ ID NO: 13838 - RNA, 18 nt, Artificial Sequence
  Synthetic
aggcaagggggggagagg

SEQ ID NO: 13839 - RNA, 19 nt, Artificial Sequence
  Synthetic
aaggcaagggggggagagg

SEQ ID NO: 13840 - RNA, 20 nt, Artificial Sequence
  Synthetic
caaggcaagggggggagagg

SEQ ID NO: 13841 - RNA, 21 nt, Artificial Sequence
  Synthetic
gcaaggcaagggggggagagg

SEQ ID NO: 13842 - RNA, 22 nt, Artificial Sequence
  Synthetic
ggcaaggcaagggggggagagg

SEQ ID NO: 13843 - RNA, 23 nt, Artificial Sequence
  Synthetic
gggcaaggcaagggggggagagg

SEQ ID NO: 13844 - RNA, 24 nt, Artificial Sequence
  Synthetic
ggggcaaggcaagggggggagagg

SEQ ID NO: 13845 - RNA, 18 nt, Artificial Sequence
  Synthetic
uagagagggagugagagg

SEQ ID NO: 13846 - RNA, 19 nt, Artificial Sequence
  Synthetic
auagagagggagugagagg

SEQ ID NO: 13847 - RNA, 20 nt, Artificial Sequence
  Synthetic
gauagagagggagugagagg

SEQ ID NO: 13848 - RNA, 21 nt, Artificial Sequence
  Synthetic
agauagagagggagugagagg

SEQ ID NO: 13849 - RNA, 22 nt, Artificial Sequence
  Synthetic
cagauagagagggagugagagg

SEQ ID NO: 13850 - RNA, 23 nt, Artificial Sequence
  Synthetic
gcagauagagagggagugagagg

SEQ ID NO: 13851 - RNA, 24 nt, Artificial Sequence
  Synthetic
ggcagauagagagggagugagagg

SEQ ID NO: 13852 - RNA, 18 nt, Artificial Sequence
  Synthetic
agauagccccagaggagg

SEQ ID NO: 13853 - RNA, 19 nt, Artificial Sequence
  Synthetic
uagauagccccagaggagg

SEQ ID NO: 13854 - RNA, 21 nt, Artificial Sequence
  Synthetic
aguagauagccccagaggagg

SEQ ID NO: 13855 - RNA, 22 nt, Artificial Sequence
  Synthetic
aaguagauagccccagaggagg

SEQ ID NO: 13856 - RNA, 23 nt, Artificial Sequence
  Synthetic
uaaguagauagccccagaggagg

SEQ ID NO: 13857 - RNA, 24 nt, Artificial Sequence
  Synthetic
cuaaguagauagccccagaggagg

SEQ ID NO: 13858 - RNA, 18 nt, Artificial Sequence
  Synthetic
caggaaagguggaggagg

SEQ ID NO: 13859 - RNA, 19 nt, Artificial Sequence
  Synthetic
ccaggaaagguggaggagg

SEQ ID NO: 13860 - RNA, 20 nt, Artificial Sequence
  Synthetic
uccaggaaagguggaggagg

SEQ ID NO: 13861 - RNA, 21 nt, Artificial Sequence
  Synthetic
cuccaggaaagguggaggagg

SEQ ID NO: 13862 - RNA, 22 nt, Artificial Sequence
  Synthetic
gcuccaggaaagguggaggagg

SEQ ID NO: 13863 - RNA, 23 nt, Artificial Sequence
  Synthetic
ggcuccaggaaagguggaggagg

SEQ ID NO: 13864 - RNA, 24 nt, Artificial Sequence
  Synthetic
uggcuccaggaaagguggaggagg

SEQ ID NO: 13865 - RNA, 18 nt, Artificial Sequence
  Synthetic
aaagguggaggagggagg

SEQ ID NO: 13866 - RNA, 19 nt, Artificial Sequence
  Synthetic
gaaagguggaggagggagg

SEQ ID NO: 13867 - RNA, 20 nt, Artificial Sequence
  Synthetic
ggaaagguggaggagggagg

SEQ ID NO: 13868 - RNA, 21 nt, Artificial Sequence
  Synthetic
aggaaagguggaggagggagg

SEQ ID NO: 13869 - RNA, 22 nt, Artificial Sequence
  Synthetic
caggaaagguggaggagggagg

SEQ ID NO: 13870 - RNA, 23 nt, Artificial Sequence
  Synthetic
ccaggaaagguggaggagggagg

SEQ ID NO: 13871 - RNA, 24 nt, Artificial Sequence
  Synthetic
uccaggaaagguggaggagggagg

SEQ ID NO: 13872 - RNA, 18 nt, Artificial Sequence
  Synthetic
cuggcuuguggagggagg

SEQ ID NO: 13873 - RNA, 19 nt, Artificial Sequence
  Synthetic
gcuggcuuguggagggagg

SEQ ID NO: 13874 - RNA, 20 nt, Artificial Sequence
  Synthetic
ugcuggcuuguggagggagg

SEQ ID NO: 13875 - RNA, 21 nt, Artificial Sequence
  Synthetic
cugcuggcuuguggagggagg

SEQ ID NO: 13876 - RNA, 22 nt, Artificial Sequence
  Synthetic
ucugcuggcuuguggagggagg

SEQ ID NO: 13877 - RNA, 23 nt, Artificial Sequence
  Synthetic
gucugcuggcuuguggagggagg

SEQ ID NO: 13878 - RNA, 24 nt, Artificial Sequence
  Synthetic
ugucugcuggcuuguggagggagg

SEQ ID NO: 13879 - RNA, 18 nt, Artificial Sequence
  Synthetic
agacacagauccuggagg

SEQ ID NO: 13880 - RNA, 19 nt, Artificial Sequence
  Synthetic
gagacacagauccuggagg

SEQ ID NO: 13881 - RNA, 20 nt, Artificial Sequence
  Synthetic
ugagacacagauccuggagg

SEQ ID NO: 13882 - RNA, 21 nt, Artificial Sequence
  Synthetic
cugagacacagauccuggagg

SEQ ID NO: 13883 - RNA, 22 nt, Artificial Sequence
  Synthetic
gcugagacacagauccuggagg

SEQ ID NO: 13884 - RNA, 23 nt, Artificial Sequence
  Synthetic
agcugagacacagauccuggagg

SEQ ID NO: 13885 - RNA, 24 nt, Artificial Sequence
  Synthetic
gagcugagacacagauccuggagg

SEQ ID NO: 13886 - RNA, 18 nt, Artificial Sequence
  Synthetic
cuccaggaaagguggagg

SEQ ID NO: 13887 - RNA, 19 nt, Artificial Sequence
  Synthetic
gcuccaggaaagguggagg

SEQ ID NO: 13888 - RNA, 21 nt, Artificial Sequence
  Synthetic
uggcuccaggaaagguggagg

SEQ ID NO: 13889 - RNA, 22 nt, Artificial Sequence
  Synthetic
cuggcuccaggaaagguggagg

SEQ ID NO: 13890 - RNA, 23 nt, Artificial Sequence
  Synthetic
gcuggcuccaggaaagguggagg

SEQ ID NO: 13891 - RNA, 24 nt, Artificial Sequence
  Synthetic
ugcuggcuccaggaaagguggagg

SEQ ID NO: 13892 - RNA, 18 nt, Artificial Sequence
  Synthetic
ucucugcagggccugagg

SEQ ID NO: 13893 - RNA, 19 nt, Artificial Sequence
  Synthetic
uucucugcagggccugagg

SEQ ID NO: 13894 - RNA, 20 nt, Artificial Sequence
  Synthetic
cuucucugcagggccugagg

SEQ ID NO: 13895 - RNA, 21 nt, Artificial Sequence
  Synthetic
ucuucucugcagggccugagg

SEQ ID NO: 13896 - RNA, 22 nt, Artificial Sequence
  Synthetic
cucuucucugcagggccugagg

SEQ ID NO: 13897 - RNA, 23 nt, Artificial Sequence
  Synthetic
ucucuucucugcagggccugagg

SEQ ID NO: 13898 - RNA, 24 nt, Artificial Sequence
  Synthetic
cucucuucucugcagggccugagg

SEQ ID NO: 13899 - RNA, 18 nt, Artificial Sequence
  Synthetic
ugcaccugucaggugagg

SEQ ID NO: 13900 - RNA, 19 nt, Artificial Sequence
  Synthetic
cugcaccugucaggugagg

SEQ ID NO: 13901 - RNA, 21 nt, Artificial Sequence
  Synthetic
cgcugcaccugucaggugagg

SEQ ID NO: 13902 - RNA, 22 nt, Artificial Sequence
  Synthetic
ccgcugcaccugucaggugagg

SEQ ID NO: 13903 - RNA, 23 nt, Artificial Sequence
  Synthetic
gccgcugcaccugucaggugagg

SEQ ID NO: 13904 - RNA, 24 nt, Artificial Sequence
  Synthetic
ggccgcugcaccugucaggugagg

SEQ ID NO: 13905 - RNA, 18 nt, Artificial Sequence
  Synthetic
ucccuggccggccagcgg

SEQ ID NO: 13906 - RNA, 19 nt, Artificial Sequence
  Synthetic
aucccuggccggccagcgg

SEQ ID NO: 13907 - RNA, 20 nt, Artificial Sequence
  Synthetic
caucccuggccggccagcgg

SEQ ID NO: 13908 - RNA, 21 nt, Artificial Sequence
  Synthetic
ccaucccuggccggccagcgg

SEQ ID NO: 13909 - RNA, 22 nt, Artificial Sequence
  Synthetic
uccaucccuggccggccagcgg

SEQ ID NO: 13910 - RNA, 23 nt, Artificial Sequence
  Synthetic
uuccaucccuggccggccagcgg

SEQ ID NO: 13911 - RNA, 24 nt, Artificial Sequence
  Synthetic
cuuccaucccuggccggccagcgg

SEQ ID NO: 13912 - RNA, 18 nt, Artificial Sequence
  Synthetic
gagggggcaaggcaaggg

SEQ ID NO: 13913 - RNA, 19 nt, Artificial Sequence
  Synthetic
agagggggcaaggcaaggg

SEQ ID NO: 13914 - RNA, 21 nt, Artificial Sequence
  Synthetic
ugagagggggcaaggcaaggg

SEQ ID NO: 13915 - RNA, 22 nt, Artificial Sequence
  Synthetic
gugagagggggcaaggcaaggg

SEQ ID NO: 13916 - RNA, 23 nt, Artificial Sequence
  Synthetic
agugagagggggcaaggcaaggg

SEQ ID NO: 13917 - RNA, 24 nt, Artificial Sequence
  Synthetic
gagugagagggggcaaggcaaggg

SEQ ID NO: 13918 - RNA, 18 nt, Artificial Sequence
  Synthetic
aggaaagguggaggaggg

SEQ ID NO: 13919 - RNA, 19 nt, Artificial Sequence
  Synthetic
caggaaagguggaggaggg

SEQ ID NO: 13920 - RNA, 21 nt, Artificial Sequence
  Synthetic
uccaggaaagguggaggaggg

SEQ ID NO: 13921 - RNA, 22 nt, Artificial Sequence
  Synthetic
cuccaggaaagguggaggaggg

SEQ ID NO: 13922 - RNA, 23 nt, Artificial Sequence
  Synthetic
gcuccaggaaagguggaggaggg

SEQ ID NO: 13923 - RNA, 24 nt, Artificial Sequence
  Synthetic
ggcuccaggaaagguggaggaggg

SEQ ID NO: 13924 - RNA, 18 nt, Artificial Sequence
  Synthetic
ucccacuuagugagcggg

SEQ ID NO: 13925 - RNA, 19 nt, Artificial Sequence
  Synthetic
cucccacuuagugagcggg

SEQ ID NO: 13926 - RNA, 20 nt, Artificial Sequence
  Synthetic
gcucccacuuagugagcggg

SEQ ID NO: 13927 - RNA, 21 nt, Artificial Sequence
  Synthetic
ugcucccacuuagugagcggg

SEQ ID NO: 13928 - RNA, 22 nt, Artificial Sequence
  Synthetic
cugcucccacuuagugagcggg

SEQ ID NO: 13929 - RNA, 23 nt, Artificial Sequence
  Synthetic
gcugcucccacuuagugagcggg

SEQ ID NO: 13930 - RNA, 24 nt, Artificial Sequence
  Synthetic
cgcugcucccacuuagugagcggg

SEQ ID NO: 13931 - RNA, 18 nt, Artificial Sequence
  Synthetic
agggggcaaggcaagggg

SEQ ID NO: 13932 - RNA, 19 nt, Artificial Sequence
  Synthetic
gagggggcaaggcaagggg

SEQ ID NO: 13933 - RNA, 21 nt, Artificial Sequence
  Synthetic
gagagggggcaaggcaagggg

SEQ ID NO: 13934 - RNA, 22 nt, Artificial Sequence
  Synthetic
ugagagggggcaaggcaagggg

SEQ ID NO: 13935 - RNA, 23 nt, Artificial Sequence
  Synthetic
gugagagggggcaaggcaagggg

SEQ ID NO: 13936 - RNA, 24 nt, Artificial Sequence
  Synthetic
agugagagggggcaaggcaagggg

SEQ ID NO: 13937 - RNA, 18 nt, Artificial Sequence
  Synthetic
caccugucaggugagggg

SEQ ID NO: 13938 - RNA, 19 nt, Artificial Sequence
  Synthetic
gcaccugucaggugagggg

SEQ ID NO: 13939 - RNA, 20 nt, Artificial Sequence
  Synthetic
ugcaccugucaggugagggg

SEQ ID NO: 13940 - RNA, 21 nt, Artificial Sequence
  Synthetic
cugcaccugucaggugagggg

SEQ ID NO: 13941 - RNA, 22 nt, Artificial Sequence
  Synthetic
gcugcaccugucaggugagggg

SEQ ID NO: 13942 - RNA, 23 nt, Artificial Sequence
  Synthetic
cgcugcaccugucaggugagggg

SEQ ID NO: 13943 - RNA, 24 nt, Artificial Sequence
  Synthetic
ccgcugcaccugucaggugagggg

SEQ ID NO: 13944 - RNA, 18 nt, Artificial Sequence
  Synthetic
cccacuuagugagcgggg

SEQ ID NO: 13945 - RNA, 19 nt, Artificial Sequence
  Synthetic
ucccacuuagugagcgggg

SEQ ID NO: 13946 - RNA, 21 nt, Artificial Sequence
  Synthetic
gcucccacuuagugagcgggg

SEQ ID NO: 13947 - RNA, 22 nt, Artificial Sequence
  Synthetic
ugcucccacuuagugagcgggg

SEQ ID NO: 13948 - RNA, 23 nt, Artificial Sequence
  Synthetic
cugcucccacuuagugagcgggg

SEQ ID NO: 13949 - RNA, 24 nt, Artificial Sequence
  Synthetic
gcugcucccacuuagugagcgggg

SEQ ID NO: 13950 - RNA, 18 nt, Artificial Sequence
  Synthetic
aagaccaaaggaaggggg

SEQ ID NO: 13951 - RNA, 19 nt, Artificial Sequence
  Synthetic
gaagaccaaaggaaggggg

SEQ ID NO: 13952 - RNA, 20 nt, Artificial Sequence
  Synthetic
agaagaccaaaggaaggggg

SEQ ID NO: 13953 - RNA, 21 nt, Artificial Sequence
  Synthetic
aagaagaccaaaggaaggggg

SEQ ID NO: 13954 - RNA, 22 nt, Artificial Sequence
  Synthetic
gaagaagaccaaaggaaggggg

SEQ ID NO: 13955 - RNA, 23 nt, Artificial Sequence
  Synthetic
ggaagaagaccaaaggaaggggg

SEQ ID NO: 13956 - RNA, 24 nt, Artificial Sequence
  Synthetic
aggaagaagaccaaaggaaggggg

SEQ ID NO: 13957 - RNA, 18 nt, Artificial Sequence
  Synthetic
accugucaggugaggggg

SEQ ID NO: 13958 - RNA, 19 nt, Artificial Sequence
  Synthetic
caccugucaggugaggggg

SEQ ID NO: 13959 - RNA, 21 nt, Artificial Sequence
  Synthetic
ugcaccugucaggugaggggg

SEQ ID NO: 13960 - RNA, 22 nt, Artificial Sequence
  Synthetic
cugcaccugucaggugaggggg

SEQ ID NO: 13961 - RNA, 23 nt, Artificial Sequence
  Synthetic
gcugcaccugucaggugaggggg

SEQ ID NO: 13962 - RNA, 24 nt, Artificial Sequence
  Synthetic
cgcugcaccugucaggugaggggg

SEQ ID NO: 13963 - RNA, 18 nt, Artificial Sequence
  Synthetic
ggggcaaggcaagggggg

SEQ ID NO: 13964 - RNA, 19 nt, Artificial Sequence
  Synthetic
gggggcaaggcaagggggg

SEQ ID NO: 13965 - RNA, 20 nt, Artificial Sequence
  Synthetic
agggggcaaggcaagggggg

SEQ ID NO: 13966 - RNA, 21 nt, Artificial Sequence
  Synthetic
gagggggcaaggcaagggggg

SEQ ID NO: 13967 - RNA, 22 nt, Artificial Sequence
  Synthetic
agagggggcaaggcaagggggg

SEQ ID NO: 13968 - RNA, 23 nt, Artificial Sequence
  Synthetic
gagagggggcaaggcaagggggg

SEQ ID NO: 13969 - RNA, 24 nt, Artificial Sequence
  Synthetic
ugagagggggcaaggcaagggggg

SEQ ID NO: 13970 - RNA, 18 nt, Artificial Sequence
  Synthetic
agcccugcaguccugggg

SEQ ID NO: 13971 - RNA, 19 nt, Artificial Sequence
  Synthetic
gagcccugcaguccugggg

SEQ ID NO: 13972 - RNA, 20 nt, Artificial Sequence
  Synthetic
ggagcccugcaguccugggg

SEQ ID NO: 13973 - RNA, 21 nt, Artificial Sequence
  Synthetic
uggagcccugcaguccugggg

SEQ ID NO: 13974 - RNA, 22 nt, Artificial Sequence
  Synthetic
cuggagcccugcaguccugggg

SEQ ID NO: 13975 - RNA, 23 nt, Artificial Sequence
  Synthetic
ccuggagcccugcaguccugggg

SEQ ID NO: 13976 - RNA, 24 nt, Artificial Sequence
  Synthetic
uccuggagcccugcaguccugggg

SEQ ID NO: 13977 - RNA, 18 nt, Artificial Sequence
  Synthetic
cugagacacagauccugg

SEQ ID NO: 13978 - RNA, 19 nt, Artificial Sequence
  Synthetic
gcugagacacagauccugg

SEQ ID NO: 13979 - RNA, 21 nt, Artificial Sequence
  Synthetic
gagcugagacacagauccugg

SEQ ID NO: 13980 - RNA, 22 nt, Artificial Sequence
  Synthetic
ggagcugagacacagauccugg

SEQ ID NO: 13981 - RNA, 23 nt, Artificial Sequence
  Synthetic
aggagcugagacacagauccugg

SEQ ID NO: 13982 - RNA, 24 nt, Artificial Sequence
  Synthetic
caggagcugagacacagauccugg

SEQ ID NO: 13983 - RNA, 18 nt, Artificial Sequence
  Synthetic
uggcuccaggaaaggugg

SEQ ID NO: 13984 - RNA, 19 nt, Artificial Sequence
  Synthetic
cuggcuccaggaaaggugg

SEQ ID NO: 13985 - RNA, 21 nt, Artificial Sequence
  Synthetic
ugcuggcuccaggaaaggugg

SEQ ID NO: 13986 - RNA, 22 nt, Artificial Sequence
  Synthetic
cugcuggcuccaggaaaggugg

SEQ ID NO: 13987 - RNA, 23 nt, Artificial Sequence
  Synthetic
ucugcuggcuccaggaaaggugg

SEQ ID NO: 13988 - RNA, 24 nt, Artificial Sequence
  Synthetic
gucugcuggcuccaggaaaggugg

SEQ ID NO: 13989 - RNA, 18 nt, Artificial Sequence
  Synthetic
uugucugcuggcuugugg

SEQ ID NO: 13990 - RNA, 19 nt, Artificial Sequence
  Synthetic
uuugucugcuggcuugugg

SEQ ID NO: 13991 - RNA, 21 nt, Artificial Sequence
  Synthetic
ccuuugucugcuggcuugugg

SEQ ID NO: 13992 - RNA, 22 nt, Artificial Sequence
  Synthetic
gccuuugucugcuggcuugugg

SEQ ID NO: 13993 - RNA, 23 nt, Artificial Sequence
  Synthetic
ggccuuugucugcuggcuugugg

SEQ ID NO: 13994 - RNA, 24 nt, Artificial Sequence
  Synthetic
gggccuuugucugcuggcuugugg

SEQ ID NO: 13995 - RNA, 18 nt, Artificial Sequence
  Synthetic
gggucuggacaagguugg

SEQ ID NO: 13996 - RNA, 19 nt, Artificial Sequence
  Synthetic
cgggucuggacaagguugg

SEQ ID NO: 13997 - RNA, 21 nt, Artificial Sequence
  Synthetic
cccgggucuggacaagguugg

SEQ ID NO: 13998 - RNA, 22 nt, Artificial Sequence
  Synthetic
ucccgggucuggacaagguugg

SEQ ID NO: 13999 - RNA, 23 nt, Artificial Sequence
  Synthetic
cucccgggucuggacaagguugg

SEQ ID NO: 14000 - RNA, 24 nt, Artificial Sequence
  Synthetic
ccucccgggucuggacaagguugg

SEQ ID NO: 14001 - RNA, 18 nt, Artificial Sequence
  Synthetic
uucuucauuaggacaaug

SEQ ID NO: 14002 - RNA, 19 nt, Artificial Sequence
  Synthetic
uuucuucauuaggacaaug

SEQ ID NO: 14003 - RNA, 20 nt, Artificial Sequence
  Synthetic
guuucuucauuaggacaaug

SEQ ID NO: 14004 - RNA, 21 nt, Artificial Sequence
  Synthetic
aguuucuucauuaggacaaug

SEQ ID NO: 14005 - RNA, 22 nt, Artificial Sequence
  Synthetic
caguuucuucauuaggacaaug

SEQ ID NO: 14006 - RNA, 23 nt, Artificial Sequence
  Synthetic
ucaguuucuucauuaggacaaug

SEQ ID NO: 14007 - RNA, 24 nt, Artificial Sequence
  Synthetic
gucaguuucuucauuaggacaaug

SEQ ID NO: 14008 - RNA, 18 nt, Artificial Sequence
  Synthetic
aggggucucugggauaug

SEQ ID NO: 14009 - RNA, 19 nt, Artificial Sequence
  Synthetic
uaggggucucugggauaug

SEQ ID NO: 14010 - RNA, 21 nt, Artificial Sequence
  Synthetic
ucuaggggucucugggauaug

SEQ ID NO: 14011 - RNA, 22 nt, Artificial Sequence
  Synthetic
uucuaggggucucugggauaug

SEQ ID NO: 14012 - RNA, 23 nt, Artificial Sequence
  Synthetic
uuucuaggggucucugggauaug

SEQ ID NO: 14013 - RNA, 24 nt, Artificial Sequence
  Synthetic
guuucuaggggucucugggauaug

SEQ ID NO: 14014 - RNA, 18 nt, Artificial Sequence
  Synthetic
gagcggggaggagaccug

SEQ ID NO: 14015 - RNA, 19 nt, Artificial Sequence
  Synthetic
ugagcggggaggagaccug

SEQ ID NO: 14016 - RNA, 20 nt, Artificial Sequence
  Synthetic
gugagcggggaggagaccug

SEQ ID NO: 14017 - RNA, 21 nt, Artificial Sequence
  Synthetic
agugagcggggaggagaccug

SEQ ID NO: 14018 - RNA, 22 nt, Artificial Sequence
  Synthetic
uagugagcggggaggagaccug

SEQ ID NO: 14019 - RNA, 23 nt, Artificial Sequence
  Synthetic
uuagugagcggggaggagaccug

SEQ ID NO: 14020 - RNA, 24 nt, Artificial Sequence
  Synthetic
cuuagugagcggggaggagaccug

SEQ ID NO: 14021 - RNA, 18 nt, Artificial Sequence
  Synthetic
gcugagacacagauccug

SEQ ID NO: 14022 - RNA, 19 nt, Artificial Sequence
  Synthetic
agcugagacacagauccug

SEQ ID NO: 14023 - RNA, 20 nt, Artificial Sequence
  Synthetic
gagcugagacacagauccug

SEQ ID NO: 14024 - RNA, 21 nt, Artificial Sequence
  Synthetic
ggagcugagacacagauccug

SEQ ID NO: 14025 - RNA, 22 nt, Artificial Sequence
  Synthetic
aggagcugagacacagauccug

SEQ ID NO: 14026 - RNA, 23 nt, Artificial Sequence
  Synthetic
caggagcugagacacagauccug

SEQ ID NO: 14027 - RNA, 24 nt, Artificial Sequence
  Synthetic
gcaggagcugagacacagauccug

SEQ ID NO: 14028 - RNA, 18 nt, Artificial Sequence
  Synthetic
acucugggcugccuccug

SEQ ID NO: 14029 - RNA, 19 nt, Artificial Sequence
  Synthetic
cacucugggcugccuccug

SEQ ID NO: 14030 - RNA, 21 nt, Artificial Sequence
  Synthetic
ugcacucugggcugccuccug

SEQ ID NO: 14031 - RNA, 22 nt, Artificial Sequence
  Synthetic
cugcacucugggcugccuccug

SEQ ID NO: 14032 - RNA, 23 nt, Artificial Sequence
  Synthetic
ccugcacucugggcugccuccug

SEQ ID NO: 14033 - RNA, 24 nt, Artificial Sequence
  Synthetic
uccugcacucugggcugccuccug

SEQ ID NO: 14034 - RNA, 18 nt, Artificial Sequence
  Synthetic
ccucuucucucuucucug

SEQ ID NO: 14035 - RNA, 19 nt, Artificial Sequence
  Synthetic
accucuucucucuucucug

SEQ ID NO: 14036 - RNA, 20 nt, Artificial Sequence
  Synthetic
gaccucuucucucuucucug

SEQ ID NO: 14037 - RNA, 21 nt, Artificial Sequence
  Synthetic
agaccucuucucucuucucug

SEQ ID NO: 14038 - RNA, 22 nt, Artificial Sequence
  Synthetic
gagaccucuucucucuucucug

SEQ ID NO: 14039 - RNA, 23 nt, Artificial Sequence
  Synthetic
agagaccucuucucucuucucug

SEQ ID NO: 14040 - RNA, 24 nt, Artificial Sequence
  Synthetic
cagagaccucuucucucuucucug

SEQ ID NO: 14041 - RNA, 18 nt, Artificial Sequence
  Synthetic
ggggcaguggggacagug

SEQ ID NO: 14042 - RNA, 19 nt, Artificial Sequence
  Synthetic
uggggcaguggggacagug

SEQ ID NO: 14043 - RNA, 20 nt, Artificial Sequence
  Synthetic
guggggcaguggggacagug

SEQ ID NO: 14044 - RNA, 21 nt, Artificial Sequence
  Synthetic
uguggggcaguggggacagug

SEQ ID NO: 14045 - RNA, 22 nt, Artificial Sequence
  Synthetic
auguggggcaguggggacagug

SEQ ID NO: 14046 - RNA, 23 nt, Artificial Sequence
  Synthetic
uauguggggcaguggggacagug

SEQ ID NO: 14047 - RNA, 24 nt, Artificial Sequence
  Synthetic
auauguggggcaguggggacagug

SEQ ID NO: 14048 - RNA, 18 nt, Artificial Sequence
  Synthetic
gggcucugugugggagug

SEQ ID NO: 14049 - RNA, 19 nt, Artificial Sequence
  Synthetic
cgggcucugugugggagug

SEQ ID NO: 14050 - RNA, 21 nt, Artificial Sequence
  Synthetic
cacgggcucugugugggagug

SEQ ID NO: 14051 - RNA, 22 nt, Artificial Sequence
  Synthetic
ccacgggcucugugugggagug

SEQ ID NO: 14052 - RNA, 23 nt, Artificial Sequence
  Synthetic
uccacgggcucugugugggagug

SEQ ID NO: 14053 - RNA, 24 nt, Artificial Sequence
  Synthetic
auccacgggcucugugugggagug

SEQ ID NO: 14054 - RNA, 18 nt, Artificial Sequence
  Synthetic
ccuccuguggggcccgug

SEQ ID NO: 14055 - RNA, 19 nt, Artificial Sequence
  Synthetic
gccuccuguggggcccgug

SEQ ID NO: 14056 - RNA, 21 nt, Artificial Sequence
  Synthetic
cugccuccuguggggcccgug

SEQ ID NO: 14057 - RNA, 22 nt, Artificial Sequence
  Synthetic
gcugccuccuguggggcccgug

SEQ ID NO: 14058 - RNA, 23 nt, Artificial Sequence
  Synthetic
ggcugccuccuguggggcccgug

SEQ ID NO: 14059 - RNA, 24 nt, Artificial Sequence
  Synthetic
gggcugccuccuguggggcccgug

SEQ ID NO: 14060 - RNA, 18 nt, Artificial Sequence
  Synthetic
agccuucccugccgcgug

SEQ ID NO: 14061 - RNA, 19 nt, Artificial Sequence
  Synthetic
cagccuucccugccgcgug

SEQ ID NO: 14062 - RNA, 20 nt, Artificial Sequence
  Synthetic
gcagccuucccugccgcgug

SEQ ID NO: 14063 - RNA, 21 nt, Artificial Sequence
  Synthetic
ggcagccuucccugccgcgug

SEQ ID NO: 14064 - RNA, 22 nt, Artificial Sequence
  Synthetic
cggcagccuucccugccgcgug

SEQ ID NO: 14065 - RNA, 23 nt, Artificial Sequence
  Synthetic
gcggcagccuucccugccgcgug

SEQ ID NO: 14066 - RNA, 24 nt, Artificial Sequence
  Synthetic
agcggcagccuucccugccgcgug

SEQ ID NO: 14067 - RNA, 18 nt, Artificial Sequence
  Synthetic
cuggcuccaggaaaggug

SEQ ID NO: 14068 - RNA, 19 nt, Artificial Sequence
  Synthetic
gcuggcuccaggaaaggug

SEQ ID NO: 14069 - RNA, 20 nt, Artificial Sequence
  Synthetic
ugcuggcuccaggaaaggug

SEQ ID NO: 14070 - RNA, 21 nt, Artificial Sequence
  Synthetic
cugcuggcuccaggaaaggug

SEQ ID NO: 14071 - RNA, 22 nt, Artificial Sequence
  Synthetic
ucugcuggcuccaggaaaggug

SEQ ID NO: 14072 - RNA, 23 nt, Artificial Sequence
  Synthetic
gucugcuggcuccaggaaaggug

SEQ ID NO: 14073 - RNA, 24 nt, Artificial Sequence
  Synthetic
ggucugcuggcuccaggaaaggug

SEQ ID NO: 14074 - RNA, 18 nt, Artificial Sequence
  Synthetic
cgcugcaccugucaggug

SEQ ID NO: 14075 - RNA, 19 nt, Artificial Sequence
  Synthetic
ccgcugcaccugucaggug

SEQ ID NO: 14076 - RNA, 21 nt, Artificial Sequence
  Synthetic
ggccgcugcaccugucaggug

SEQ ID NO: 14077 - RNA, 22 nt, Artificial Sequence
  Synthetic
aggccgcugcaccugucaggug

SEQ ID NO: 14078 - RNA, 23 nt, Artificial Sequence
  Synthetic
caggccgcugcaccugucaggug

SEQ ID NO: 14079 - RNA, 24 nt, Artificial Sequence
  Synthetic
ccaggccgcugcaccugucaggug

SEQ ID NO: 14080 - RNA, 18 nt, Artificial Sequence
  Synthetic
gaucaaacagccagggug

SEQ ID NO: 14081 - RNA, 19 nt, Artificial Sequence
  Synthetic
agaucaaacagccagggug

SEQ ID NO: 14082 - RNA, 20 nt, Artificial Sequence
  Synthetic
gagaucaaacagccagggug

SEQ ID NO: 14083 - RNA, 21 nt, Artificial Sequence
  Synthetic
ugagaucaaacagccagggug

SEQ ID NO: 14084 - RNA, 22 nt, Artificial Sequence
  Synthetic
uugagaucaaacagccagggug

SEQ ID NO: 14085 - RNA, 23 nt, Artificial Sequence
  Synthetic
uuugagaucaaacagccagggug

SEQ ID NO: 14086 - RNA, 24 nt, Artificial Sequence
  Synthetic
cuuugagaucaaacagccagggug

SEQ ID NO: 14087 - RNA, 18 nt, Artificial Sequence
  Synthetic
acaagguuggagggggug

SEQ ID NO: 14088 - RNA, 19 nt, Artificial Sequence
  Synthetic
gacaagguuggagggggug

SEQ ID NO: 14089 - RNA, 20 nt, Artificial Sequence
  Synthetic
ggacaagguuggagggggug

SEQ ID NO: 14090 - RNA, 21 nt, Artificial Sequence
  Synthetic
uggacaagguuggagggggug

SEQ ID NO: 14091 - RNA, 22 nt, Artificial Sequence
  Synthetic
cuggacaagguuggagggggug

SEQ ID NO: 14092 - RNA, 23 nt, Artificial Sequence
  Synthetic
ucuggacaagguuggagggggug

SEQ ID NO: 14093 - RNA, 24 nt, Artificial Sequence
  Synthetic
gucuggacaagguuggagggggug

SEQ ID NO: 14094 - RNA, 18 nt, Artificial Sequence
  Synthetic
gaauccacgggcucugug

SEQ ID NO: 14095 - RNA, 19 nt, Artificial Sequence
  Synthetic
cgaauccacgggcucugug

SEQ ID NO: 14096 - RNA, 21 nt, Artificial Sequence
  Synthetic
gacgaauccacgggcucugug

SEQ ID NO: 14097 - RNA, 22 nt, Artificial Sequence
  Synthetic
agacgaauccacgggcucugug

SEQ ID NO: 14098 - RNA, 23 nt, Artificial Sequence
  Synthetic
cagacgaauccacgggcucugug

SEQ ID NO: 14099 - RNA, 24 nt, Artificial Sequence
  Synthetic
gcagacgaauccacgggcucugug

SEQ ID NO: 14100 - RNA, 18 nt, Artificial Sequence
  Synthetic
uuugucugcuggcuugug

SEQ ID NO: 14101 - RNA, 19 nt, Artificial Sequence
  Synthetic
cuuugucugcuggcuugug

SEQ ID NO: 14102 - RNA, 20 nt, Artificial Sequence
  Synthetic
ccuuugucugcuggcuugug

SEQ ID NO: 14103 - RNA, 21 nt, Artificial Sequence
  Synthetic
gccuuugucugcuggcuugug

SEQ ID NO: 14104 - RNA, 22 nt, Artificial Sequence
  Synthetic
ggccuuugucugcuggcuugug

SEQ ID NO: 14105 - RNA, 23 nt, Artificial Sequence
  Synthetic
gggccuuugucugcuggcuugug

SEQ ID NO: 14106 - RNA, 24 nt, Artificial Sequence
  Synthetic
ugggccuuugucugcuggcuugug

SEQ ID NO: 14107 - RNA, 18 nt, Artificial Sequence
  Synthetic
gugcugagcaccuuauug

SEQ ID NO: 14108 - RNA, 19 nt, Artificial Sequence
  Synthetic
ggugcugagcaccuuauug

SEQ ID NO: 14109 - RNA, 20 nt, Artificial Sequence
  Synthetic
gggugcugagcaccuuauug

SEQ ID NO: 14110 - RNA, 21 nt, Artificial Sequence
  Synthetic
agggugcugagcaccuuauug

SEQ ID NO: 14111 - RNA, 22 nt, Artificial Sequence
  Synthetic
cagggugcugagcaccuuauug

SEQ ID NO: 14112 - RNA, 23 nt, Artificial Sequence
  Synthetic
ccagggugcugagcaccuuauug

SEQ ID NO: 14113 - RNA, 24 nt, Artificial Sequence
  Synthetic
gccagggugcugagcaccuuauug

SEQ ID NO: 14114 - RNA, 18 nt, Artificial Sequence
  Synthetic
uggagggcugcccacuug

SEQ ID NO: 14115 - RNA, 19 nt, Artificial Sequence
  Synthetic
uuggagggcugcccacuug

SEQ ID NO: 14116 - RNA, 20 nt, Artificial Sequence
  Synthetic
cuuggagggcugcccacuug

SEQ ID NO: 14117 - RNA, 21 nt, Artificial Sequence
  Synthetic
ccuuggagggcugcccacuug

SEQ ID NO: 14118 - RNA, 22 nt, Artificial Sequence
  Synthetic
cccuuggagggcugcccacuug

SEQ ID NO: 14119 - RNA, 23 nt, Artificial Sequence
  Synthetic
gcccuuggagggcugcccacuug

SEQ ID NO: 14120 - RNA, 24 nt, Artificial Sequence
  Synthetic
ugcccuuggagggcugcccacuug

SEQ ID NO: 14121 - RNA, 18 nt, Artificial Sequence
  Synthetic
gaccugugggugcccuug

SEQ ID NO: 14122 - RNA, 19 nt, Artificial Sequence
  Synthetic
ugaccugugggugcccuug

SEQ ID NO: 14123 - RNA, 20 nt, Artificial Sequence
  Synthetic
cugaccugugggugcccuug

SEQ ID NO: 14124 - RNA, 21 nt, Artificial Sequence
  Synthetic
gcugaccugugggugcccuug

SEQ ID NO: 14125 - RNA, 22 nt, Artificial Sequence
  Synthetic
ggcugaccugugggugcccuug

SEQ ID NO: 14126 - RNA, 23 nt, Artificial Sequence
  Synthetic
aggcugaccugugggugcccuug

SEQ ID NO: 14127 - RNA, 24 nt, Artificial Sequence
  Synthetic
gaggcugaccugugggugcccuug

SEQ ID NO: 14128 - RNA, 18 nt, Artificial Sequence
  Synthetic
ccuuugucugcuggcuug

SEQ ID NO: 14129 - RNA, 19 nt, Artificial Sequence
  Synthetic
gccuuugucugcuggcuug

SEQ ID NO: 14130 - RNA, 21 nt, Artificial Sequence
  Synthetic
gggccuuugucugcuggcuug

SEQ ID NO: 14131 - RNA, 22 nt, Artificial Sequence
  Synthetic
ugggccuuugucugcuggcuug

SEQ ID NO: 14132 - RNA, 23 nt, Artificial Sequence
  Synthetic
cugggccuuugucugcuggcuug

SEQ ID NO: 14133 - RNA, 24 nt, Artificial Sequence
  Synthetic
gcugggccuuugucugcuggcuug

SEQ ID NO: 14134 - RNA, 18 nt, Artificial Sequence
  Synthetic
cgggucuggacaagguug

SEQ ID NO: 14135 - RNA, 19 nt, Artificial Sequence
  Synthetic
ccgggucuggacaagguug

SEQ ID NO: 14136 - RNA, 20 nt, Artificial Sequence
  Synthetic
cccgggucuggacaagguug

SEQ ID NO: 14137 - RNA, 21 nt, Artificial Sequence
  Synthetic
ucccgggucuggacaagguug

SEQ ID NO: 14138 - RNA, 22 nt, Artificial Sequence
  Synthetic
cucccgggucuggacaagguug

SEQ ID NO: 14139 - RNA, 23 nt, Artificial Sequence
  Synthetic
ccucccgggucuggacaagguug

SEQ ID NO: 14140 - RNA, 24 nt, Artificial Sequence
  Synthetic
cccucccgggucuggacaagguug

SEQ ID NO: 14141 - RNA, 18 nt, Artificial Sequence
  Synthetic
guuuggaaagagauuuug

SEQ ID NO: 14142 - RNA, 19 nt, Artificial Sequence
  Synthetic
aguuuggaaagagauuuug

SEQ ID NO: 14143 - RNA, 20 nt, Artificial Sequence
  Synthetic
aaguuuggaaagagauuuug

SEQ ID NO: 14144 - RNA, 21 nt, Artificial Sequence
  Synthetic
uaaguuuggaaagagauuuug

SEQ ID NO: 14145 - RNA, 22 nt, Artificial Sequence
  Synthetic
uuaaguuuggaaagagauuuug

SEQ ID NO: 14146 - RNA, 23 nt, Artificial Sequence
  Synthetic
auuaaguuuggaaagagauuuug

SEQ ID NO: 14147 - RNA, 24 nt, Artificial Sequence
  Synthetic
cauuaaguuuggaaagagauuuug

SEQ ID NO: 14148 - RNA, 18 nt, Artificial Sequence
  Synthetic
gucuuaucucugagaaau

SEQ ID NO: 14149 - RNA, 19 nt, Artificial Sequence
  Synthetic
ugucuuaucucugagaaau

SEQ ID NO: 14150 - RNA, 20 nt, Artificial Sequence
  Synthetic
augucuuaucucugagaaau

SEQ ID NO: 14151 - RNA, 21 nt, Artificial Sequence
  Synthetic
uaugucuuaucucugagaaau

SEQ ID NO: 14152 - RNA, 22 nt, Artificial Sequence
  Synthetic
uuaugucuuaucucugagaaau

SEQ ID NO: 14153 - RNA, 23 nt, Artificial Sequence
  Synthetic
cuuaugucuuaucucugagaaau

SEQ ID NO: 14154 - RNA, 24 nt, Artificial Sequence
  Synthetic
ucuuaugucuuaucucugagaaau

SEQ ID NO: 14155 - RNA, 18 nt, Artificial Sequence
  Synthetic
cuggggcagagacagaau

SEQ ID NO: 14156 - RNA, 19 nt, Artificial Sequence
  Synthetic
ccuggggcagagacagaau

SEQ ID NO: 14157 - RNA, 20 nt, Artificial Sequence
  Synthetic
uccuggggcagagacagaau

SEQ ID NO: 14158 - RNA, 21 nt, Artificial Sequence
  Synthetic
guccuggggcagagacagaau

SEQ ID NO: 14159 - RNA, 22 nt, Artificial Sequence
  Synthetic
aguccuggggcagagacagaau

SEQ ID NO: 14160 - RNA, 23 nt, Artificial Sequence
  Synthetic
caguccuggggcagagacagaau

SEQ ID NO: 14161 - RNA, 24 nt, Artificial Sequence
  Synthetic
gcaguccuggggcagagacagaau

SEQ ID NO: 14162 - RNA, 18 nt, Artificial Sequence
  Synthetic
agggaggagugggagaau

SEQ ID NO: 14163 - RNA, 19 nt, Artificial Sequence
  Synthetic
gagggaggagugggagaau

SEQ ID NO: 14164 - RNA, 20 nt, Artificial Sequence
  Synthetic
ggagggaggagugggagaau

SEQ ID NO: 14165 - RNA, 21 nt, Artificial Sequence
  Synthetic
gggagggaggagugggagaau

SEQ ID NO: 14166 - RNA, 22 nt, Artificial Sequence
  Synthetic
agggagggaggagugggagaau

SEQ ID NO: 14167 - RNA, 23 nt, Artificial Sequence
  Synthetic
gagggagggaggagugggagaau

SEQ ID NO: 14168 - RNA, 24 nt, Artificial Sequence
  Synthetic
ggagggagggaggagugggagaau

SEQ ID NO: 14169 - RNA, 18 nt, Artificial Sequence
  Synthetic
aagggucaguuucuucau

SEQ ID NO: 14170 - RNA, 19 nt, Artificial Sequence
  Synthetic
gaagggucaguuucuucau

SEQ ID NO: 14171 - RNA, 20 nt, Artificial Sequence
  Synthetic
ggaagggucaguuucuucau

SEQ ID NO: 14172 - RNA, 21 nt, Artificial Sequence
  Synthetic
gggaagggucaguuucuucau

SEQ ID NO: 14173 - RNA, 22 nt, Artificial Sequence
  Synthetic
ugggaagggucaguuucuucau

SEQ ID NO: 14174 - RNA, 23 nt, Artificial Sequence
  Synthetic
uugggaagggucaguuucuucau

SEQ ID NO: 14175 - RNA, 24 nt, Artificial Sequence
  Synthetic
cuugggaagggucaguuucuucau

SEQ ID NO: 14176 - RNA, 18 nt, Artificial Sequence
  Synthetic
gaggaagagaggcaggau

SEQ ID NO: 14177 - RNA, 19 nt, Artificial Sequence
  Synthetic
agaggaagagaggcaggau

SEQ ID NO: 14178 - RNA, 20 nt, Artificial Sequence
  Synthetic
gagaggaagagaggcaggau

SEQ ID NO: 14179 - RNA, 21 nt, Artificial Sequence
  Synthetic
ggagaggaagagaggcaggau

SEQ ID NO: 14180 - RNA, 22 nt, Artificial Sequence
  Synthetic
gggagaggaagagaggcaggau

SEQ ID NO: 14181 - RNA, 23 nt, Artificial Sequence
  Synthetic
ggggagaggaagagaggcaggau

SEQ ID NO: 14182 - RNA, 24 nt, Artificial Sequence
  Synthetic
gggggagaggaagagaggcaggau

SEQ ID NO: 14183 - RNA, 18 nt, Artificial Sequence
  Synthetic
ucucacagagcccuugau

SEQ ID NO: 14184 - RNA, 19 nt, Artificial Sequence
  Synthetic
uucucacagagcccuugau

SEQ ID NO: 14185 - RNA, 20 nt, Artificial Sequence
  Synthetic
cuucucacagagcccuugau

SEQ ID NO: 14186 - RNA, 21 nt, Artificial Sequence
  Synthetic
ucuucucacagagcccuugau

SEQ ID NO: 14187 - RNA, 22 nt, Artificial Sequence
  Synthetic
uucuucucacagagcccuugau

SEQ ID NO: 14188 - RNA, 23 nt, Artificial Sequence
  Synthetic
auucuucucacagagcccuugau

SEQ ID NO: 14189 - RNA, 24 nt, Artificial Sequence
  Synthetic
aauucuucucacagagcccuugau

SEQ ID NO: 14190 - RNA, 18 nt, Artificial Sequence
  Synthetic
uaggggucucugggauau

SEQ ID NO: 14191 - RNA, 19 nt, Artificial Sequence
  Synthetic
cuaggggucucugggauau

SEQ ID NO: 14192 - RNA, 20 nt, Artificial Sequence
  Synthetic
ucuaggggucucugggauau

SEQ ID NO: 14193 - RNA, 21 nt, Artificial Sequence
  Synthetic
uucuaggggucucugggauau

SEQ ID NO: 14194 - RNA, 22 nt, Artificial Sequence
  Synthetic
uuucuaggggucucugggauau

SEQ ID NO: 14195 - RNA, 23 nt, Artificial Sequence
  Synthetic
guuucuaggggucucugggauau

SEQ ID NO: 14196 - RNA, 24 nt, Artificial Sequence
  Synthetic
aguuucuaggggucucugggauau

SEQ ID NO: 14197 - RNA, 18 nt, Artificial Sequence
  Synthetic
cucgaaagguggcccuau

SEQ ID NO: 14198 - RNA, 19 nt, Artificial Sequence
  Synthetic
acucgaaagguggcccuau

SEQ ID NO: 14199 - RNA, 20 nt, Artificial Sequence
  Synthetic
aacucgaaagguggcccuau

SEQ ID NO: 14200 - RNA, 21 nt, Artificial Sequence
  Synthetic
aaacucgaaagguggcccuau

SEQ ID NO: 14201 - RNA, 22 nt, Artificial Sequence
  Synthetic
aaaacucgaaagguggcccuau

SEQ ID NO: 14202 - RNA, 23 nt, Artificial Sequence
  Synthetic
caaaacucgaaagguggcccuau

SEQ ID NO: 14203 - RNA, 24 nt, Artificial Sequence
  Synthetic
acaaaacucgaaagguggcccuau

SEQ ID NO: 14204 - RNA, 18 nt, Artificial Sequence
  Synthetic
agcuccuggaagcacacu

SEQ ID NO: 14205 - RNA, 19 nt, Artificial Sequence
  Synthetic
uagcuccuggaagcacacu

SEQ ID NO: 14206 - RNA, 21 nt, Artificial Sequence
  Synthetic
ucuagcuccuggaagcacacu

SEQ ID NO: 14207 - RNA, 22 nt, Artificial Sequence
  Synthetic
cucuagcuccuggaagcacacu

SEQ ID NO: 14208 - RNA, 23 nt, Artificial Sequence
  Synthetic
ccucuagcuccuggaagcacacu

SEQ ID NO: 14209 - RNA, 24 nt, Artificial Sequence
  Synthetic
gccucuagcuccuggaagcacacu

SEQ ID NO: 14210 - RNA, 18 nt, Artificial Sequence
  Synthetic
ugaccacauuccugcacu

SEQ ID NO: 14211 - RNA, 19 nt, Artificial Sequence
  Synthetic
gugaccacauuccugcacu

SEQ ID NO: 14212 - RNA, 20 nt, Artificial Sequence
  Synthetic
agugaccacauuccugcacu

SEQ ID NO: 14213 - RNA, 21 nt, Artificial Sequence
  Synthetic
cagugaccacauuccugcacu

SEQ ID NO: 14214 - RNA, 22 nt, Artificial Sequence
  Synthetic
ccagugaccacauuccugcacu

SEQ ID NO: 14215 - RNA, 23 nt, Artificial Sequence
  Synthetic
gccagugaccacauuccugcacu

SEQ ID NO: 14216 - RNA, 24 nt, Artificial Sequence
  Synthetic
agccagugaccacauuccugcacu

SEQ ID NO: 14217 - RNA, 18 nt, Artificial Sequence
  Synthetic
aggugcuuuucagaaccu

SEQ ID NO: 14218 - RNA, 19 nt, Artificial Sequence
  Synthetic
gaggugcuuuucagaaccu

SEQ ID NO: 14219 - RNA, 20 nt, Artificial Sequence
  Synthetic
ggaggugcuuuucagaaccu

SEQ ID NO: 14220 - RNA, 21 nt, Artificial Sequence
  Synthetic
gggaggugcuuuucagaaccu

SEQ ID NO: 14221 - RNA, 22 nt, Artificial Sequence
  Synthetic
agggaggugcuuuucagaaccu

SEQ ID NO: 14222 - RNA, 23 nt, Artificial Sequence
  Synthetic
cagggaggugcuuuucagaaccu

SEQ ID NO: 14223 - RNA, 24 nt, Artificial Sequence
  Synthetic
gcagggaggugcuuuucagaaccu

SEQ ID NO: 14224 - RNA, 18 nt, Artificial Sequence
  Synthetic
uauuuuguuuucuaaccu

SEQ ID NO: 14225 - RNA, 19 nt, Artificial Sequence
  Synthetic
cuauuuuguuuucuaaccu

SEQ ID NO: 14226 - RNA, 20 nt, Artificial Sequence
  Synthetic
ccuauuuuguuuucuaaccu

SEQ ID NO: 14227 - RNA, 21 nt, Artificial Sequence
  Synthetic
uccuauuuuguuuucuaaccu

SEQ ID NO: 14228 - RNA, 22 nt, Artificial Sequence
  Synthetic
cuccuauuuuguuuucuaaccu

SEQ ID NO: 14229 - RNA, 23 nt, Artificial Sequence
  Synthetic
gcuccuauuuuguuuucuaaccu

SEQ ID NO: 14230 - RNA, 24 nt, Artificial Sequence
  Synthetic
ugcuccuauuuuguuuucuaaccu

SEQ ID NO: 14231 - RNA, 18 nt, Artificial Sequence
  Synthetic
ucccaguucaccugcccu

SEQ ID NO: 14232 - RNA, 19 nt, Artificial Sequence
  Synthetic
cucccaguucaccugcccu

SEQ ID NO: 14233 - RNA, 21 nt, Artificial Sequence
  Synthetic
uacucccaguucaccugcccu

SEQ ID NO: 14234 - RNA, 22 nt, Artificial Sequence
  Synthetic
guacucccaguucaccugcccu

SEQ ID NO: 14235 - RNA, 23 nt, Artificial Sequence
  Synthetic
aguacucccaguucaccugcccu

SEQ ID NO: 14236 - RNA, 24 nt, Artificial Sequence
  Synthetic
caguacucccaguucaccugcccu

SEQ ID NO: 14237 - RNA, 18 nt, Artificial Sequence
  Synthetic
cugaccugugggugcccu

SEQ ID NO: 14238 - RNA, 19 nt, Artificial Sequence
  Synthetic
gcugaccugugggugcccu

SEQ ID NO: 14239 - RNA, 21 nt, Artificial Sequence
  Synthetic
aggcugaccugugggugcccu

SEQ ID NO: 14240 - RNA, 22 nt, Artificial Sequence
  Synthetic
gaggcugaccugugggugcccu

SEQ ID NO: 14241 - RNA, 23 nt, Artificial Sequence
  Synthetic
ugaggcugaccugugggugcccu

SEQ ID NO: 14242 - RNA, 24 nt, Artificial Sequence
  Synthetic
gugaggcugaccugugggugcccu

SEQ ID NO: 14243 - RNA, 18 nt, Artificial Sequence
  Synthetic
agaaaacugauuuauccu

SEQ ID NO: 14244 - RNA, 19 nt, Artificial Sequence
  Synthetic
cagaaaacugauuuauccu

SEQ ID NO: 14245 - RNA, 21 nt, Artificial Sequence
  Synthetic
cucagaaaacugauuuauccu

SEQ ID NO: 14246 - RNA, 22 nt, Artificial Sequence
  Synthetic
ccucagaaaacugauuuauccu

SEQ ID NO: 14247 - RNA, 23 nt, Artificial Sequence
  Synthetic
accucagaaaacugauuuauccu

SEQ ID NO: 14248 - RNA, 24 nt, Artificial Sequence
  Synthetic
aaccucagaaaacugauuuauccu

SEQ ID NO: 14249 - RNA, 18 nt, Artificial Sequence
  Synthetic
cacucugggcugccuccu

SEQ ID NO: 14250 - RNA, 19 nt, Artificial Sequence
  Synthetic
gcacucugggcugccuccu

SEQ ID NO: 14251 - RNA, 20 nt, Artificial Sequence
  Synthetic
ugcacucugggcugccuccu

SEQ ID NO: 14252 - RNA, 21 nt, Artificial Sequence
  Synthetic
cugcacucugggcugccuccu

SEQ ID NO: 14253 - RNA, 22 nt, Artificial Sequence
  Synthetic
ccugcacucugggcugccuccu

SEQ ID NO: 14254 - RNA, 23 nt, Artificial Sequence
  Synthetic
uccugcacucugggcugccuccu

SEQ ID NO: 14255 - RNA, 24 nt, Artificial Sequence
  Synthetic
uuccugcacucugggcugccuccu

SEQ ID NO: 14256 - RNA, 18 nt, Artificial Sequence
  Synthetic
ucgggagcccuccuuccu

SEQ ID NO: 14257 - RNA, 19 nt, Artificial Sequence
  Synthetic
cucgggagcccuccuuccu

SEQ ID NO: 14258 - RNA, 20 nt, Artificial Sequence
  Synthetic
ccucgggagcccuccuuccu

SEQ ID NO: 14259 - RNA, 21 nt, Artificial Sequence
  Synthetic
cccucgggagcccuccuuccu

SEQ ID NO: 14260 - RNA, 22 nt, Artificial Sequence
  Synthetic
gcccucgggagcccuccuuccu

SEQ ID NO: 14261 - RNA, 23 nt, Artificial Sequence
  Synthetic
ugcccucgggagcccuccuuccu

SEQ ID NO: 14262 - RNA, 24 nt, Artificial Sequence
  Synthetic
cugcccucgggagcccuccuuccu

SEQ ID NO: 14263 - RNA, 18 nt, Artificial Sequence
  Synthetic
gggccagaggcuggagcu

SEQ ID NO: 14264 - RNA, 19 nt, Artificial Sequence
  Synthetic
agggccagaggcuggagcu

SEQ ID NO: 14265 - RNA, 20 nt, Artificial Sequence
  Synthetic
cagggccagaggcuggagcu

SEQ ID NO: 14266 - RNA, 21 nt, Artificial Sequence
  Synthetic
ucagggccagaggcuggagcu

SEQ ID NO: 14267 - RNA, 22 nt, Artificial Sequence
  Synthetic
gucagggccagaggcuggagcu

SEQ ID NO: 14268 - RNA, 23 nt, Artificial Sequence
  Synthetic
ggucagggccagaggcuggagcu

SEQ ID NO: 14269 - RNA, 24 nt, Artificial Sequence
  Synthetic
aggucagggccagaggcuggagcu

SEQ ID NO: 14270 - RNA, 18 nt, Artificial Sequence
  Synthetic
uguguugcccuccuagcu

SEQ ID NO: 14271 - RNA, 19 nt, Artificial Sequence
  Synthetic
uuguguugcccuccuagcu

SEQ ID NO: 14272 - RNA, 20 nt, Artificial Sequence
  Synthetic
cuuguguugcccuccuagcu

SEQ ID NO: 14273 - RNA, 21 nt, Artificial Sequence
  Synthetic
ccuuguguugcccuccuagcu

SEQ ID NO: 14274 - RNA, 22 nt, Artificial Sequence
  Synthetic
uccuuguguugcccuccuagcu

SEQ ID NO: 14275 - RNA, 23 nt, Artificial Sequence
  Synthetic
cuccuuguguugcccuccuagcu

SEQ ID NO: 14276 - RNA, 24 nt, Artificial Sequence
  Synthetic
ucuccuuguguugcccuccuagcu

SEQ ID NO: 14277 - RNA, 18 nt, Artificial Sequence
  Synthetic
ggcucuuaugucuuaucu

SEQ ID NO: 14278 - RNA, 19 nt, Artificial Sequence
  Synthetic
uggcucuuaugucuuaucu

SEQ ID NO: 14279 - RNA, 20 nt, Artificial Sequence
  Synthetic
uuggcucuuaugucuuaucu

SEQ ID NO: 14280 - RNA, 21 nt, Artificial Sequence
  Synthetic
cuuggcucuuaugucuuaucu

SEQ ID NO: 14281 - RNA, 22 nt, Artificial Sequence
  Synthetic
ccuuggcucuuaugucuuaucu

SEQ ID NO: 14282 - RNA, 23 nt, Artificial Sequence
  Synthetic
cccuuggcucuuaugucuuaucu

SEQ ID NO: 14283 - RNA, 24 nt, Artificial Sequence
  Synthetic
gcccuuggcucuuaugucuuaucu

SEQ ID NO: 14284 - RNA, 18 nt, Artificial Sequence
  Synthetic
cucuuaugucuuaucucu

SEQ ID NO: 14285 - RNA, 19 nt, Artificial Sequence
  Synthetic
gcucuuaugucuuaucucu

SEQ ID NO: 14286 - RNA, 20 nt, Artificial Sequence
  Synthetic
ggcucuuaugucuuaucucu

SEQ ID NO: 14287 - RNA, 21 nt, Artificial Sequence
  Synthetic
uggcucuuaugucuuaucucu

SEQ ID NO: 14288 - RNA, 22 nt, Artificial Sequence
  Synthetic
uuggcucuuaugucuuaucucu

SEQ ID NO: 14289 - RNA, 23 nt, Artificial Sequence
  Synthetic
cuuggcucuuaugucuuaucucu

SEQ ID NO: 14290 - RNA, 24 nt, Artificial Sequence
  Synthetic
ccuuggcucuuaugucuuaucucu

SEQ ID NO: 14291 - RNA, 18 nt, Artificial Sequence
  Synthetic
agagaugacaccuucucu

SEQ ID NO: 14292 - RNA, 19 nt, Artificial Sequence
  Synthetic
cagagaugacaccuucucu

SEQ ID NO: 14293 - RNA, 21 nt, Artificial Sequence
  Synthetic
agcagagaugacaccuucucu

SEQ ID NO: 14294 - RNA, 22 nt, Artificial Sequence
  Synthetic
cagcagagaugacaccuucucu

SEQ ID NO: 14295 - RNA, 23 nt, Artificial Sequence
  Synthetic
ucagcagagaugacaccuucucu

SEQ ID NO: 14296 - RNA, 24 nt, Artificial Sequence
  Synthetic
uucagcagagaugacaccuucucu

SEQ ID NO: 14297 - RNA, 18 nt, Artificial Sequence
  Synthetic
uggaguuucuaggggucu

SEQ ID NO: 14298 - RNA, 19 nt, Artificial Sequence
  Synthetic
cuggaguuucuaggggucu

SEQ ID NO: 14299 - RNA, 20 nt, Artificial Sequence
  Synthetic
acuggaguuucuaggggucu

SEQ ID NO: 14300 - RNA, 21 nt, Artificial Sequence
  Synthetic
gacuggaguuucuaggggucu

SEQ ID NO: 14301 - RNA, 22 nt, Artificial Sequence
  Synthetic
agacuggaguuucuaggggucu

SEQ ID NO: 14302 - RNA, 23 nt, Artificial Sequence
  Synthetic
gagacuggaguuucuaggggucu

SEQ ID NO: 14303 - RNA, 24 nt, Artificial Sequence
  Synthetic
ggagacuggaguuucuaggggucu

SEQ ID NO: 14304 - RNA, 18 nt, Artificial Sequence
  Synthetic
ucccccaugagucugucu

SEQ ID NO: 14305 - RNA, 19 nt, Artificial Sequence
  Synthetic
aucccccaugagucugucu

SEQ ID NO: 14306 - RNA, 20 nt, Artificial Sequence
  Synthetic
gaucccccaugagucugucu

SEQ ID NO: 14307 - RNA, 21 nt, Artificial Sequence
  Synthetic
cgaucccccaugagucugucu

SEQ ID NO: 14308 - RNA, 22 nt, Artificial Sequence
  Synthetic
ccgaucccccaugagucugucu

SEQ ID NO: 14309 - RNA, 23 nt, Artificial Sequence
  Synthetic
cccgaucccccaugagucugucu

SEQ ID NO: 14310 - RNA, 24 nt, Artificial Sequence
  Synthetic
ccccgaucccccaugagucugucu

SEQ ID NO: 14311 - RNA, 18 nt, Artificial Sequence
  Synthetic
gcagagaugacaccuucu

SEQ ID NO: 14312 - RNA, 19 nt, Artificial Sequence
  Synthetic
agcagagaugacaccuucu

SEQ ID NO: 14313 - RNA, 20 nt, Artificial Sequence
  Synthetic
cagcagagaugacaccuucu

SEQ ID NO: 14314 - RNA, 21 nt, Artificial Sequence
  Synthetic
ucagcagagaugacaccuucu

SEQ ID NO: 14315 - RNA, 22 nt, Artificial Sequence
  Synthetic
uucagcagagaugacaccuucu

SEQ ID NO: 14316 - RNA, 23 nt, Artificial Sequence
  Synthetic
auucagcagagaugacaccuucu

SEQ ID NO: 14317 - RNA, 24 nt, Artificial Sequence
  Synthetic
gauucagcagagaugacaccuucu

SEQ ID NO: 14318 - RNA, 18 nt, Artificial Sequence
  Synthetic
cagaggagaggccguucu

SEQ ID NO: 14319 - RNA, 19 nt, Artificial Sequence
  Synthetic
gcagaggagaggccguucu

SEQ ID NO: 14320 - RNA, 21 nt, Artificial Sequence
  Synthetic
aagcagaggagaggccguucu

SEQ ID NO: 14321 - RNA, 22 nt, Artificial Sequence
  Synthetic
gaagcagaggagaggccguucu

SEQ ID NO: 14322 - RNA, 23 nt, Artificial Sequence
  Synthetic
ggaagcagaggagaggccguucu

SEQ ID NO: 14323 - RNA, 24 nt, Artificial Sequence
  Synthetic
gggaagcagaggagaggccguucu

SEQ ID NO: 14324 - RNA, 18 nt, Artificial Sequence
  Synthetic
ccuuuugcugcauuaagu

SEQ ID NO: 14325 - RNA, 19 nt, Artificial Sequence
  Synthetic
uccuuuugcugcauuaagu

SEQ ID NO: 14326 - RNA, 20 nt, Artificial Sequence
  Synthetic
auccuuuugcugcauuaagu

SEQ ID NO: 14327 - RNA, 21 nt, Artificial Sequence
  Synthetic
uauccuuuugcugcauuaagu

SEQ ID NO: 14328 - RNA, 22 nt, Artificial Sequence
  Synthetic
uuauccuuuugcugcauuaagu

SEQ ID NO: 14329 - RNA, 23 nt, Artificial Sequence
  Synthetic
cuuauccuuuugcugcauuaagu

SEQ ID NO: 14330 - RNA, 24 nt, Artificial Sequence
  Synthetic
ccuuauccuuuugcugcauuaagu

SEQ ID NO: 14331 - RNA, 18 nt, Artificial Sequence
  Synthetic
ugggauauguggggcagu

SEQ ID NO: 14332 - RNA, 19 nt, Artificial Sequence
  Synthetic
cugggauauguggggcagu

SEQ ID NO: 14333 - RNA, 21 nt, Artificial Sequence
  Synthetic
cucugggauauguggggcagu

SEQ ID NO: 14334 - RNA, 22 nt, Artificial Sequence
  Synthetic
ucucugggauauguggggcagu

SEQ ID NO: 14335 - RNA, 23 nt, Artificial Sequence
  Synthetic
gucucugggauauguggggcagu

SEQ ID NO: 14336 - RNA, 24 nt, Artificial Sequence
  Synthetic
ggucucugggauauguggggcagu

SEQ ID NO: 14337 - RNA, 18 nt, Artificial Sequence
  Synthetic
gagcugagggccuagagu

SEQ ID NO: 14338 - RNA, 19 nt, Artificial Sequence
  Synthetic
ggagcugagggccuagagu

SEQ ID NO: 14339 - RNA, 20 nt, Artificial Sequence
  Synthetic
uggagcugagggccuagagu

SEQ ID NO: 14340 - RNA, 21 nt, Artificial Sequence
  Synthetic
cuggagcugagggccuagagu

SEQ ID NO: 14341 - RNA, 22 nt, Artificial Sequence
  Synthetic
gcuggagcugagggccuagagu

SEQ ID NO: 14342 - RNA, 23 nt, Artificial Sequence
  Synthetic
ggcuggagcugagggccuagagu

SEQ ID NO: 14343 - RNA, 24 nt, Artificial Sequence
  Synthetic
aggcuggagcugagggccuagagu

SEQ ID NO: 14344 - RNA, 18 nt, Artificial Sequence
  Synthetic
gaggagggagggaggagu

SEQ ID NO: 14345 - RNA, 19 nt, Artificial Sequence
  Synthetic
ggaggagggagggaggagu

SEQ ID NO: 14346 - RNA, 21 nt, Artificial Sequence
  Synthetic
guggaggagggagggaggagu

SEQ ID NO: 14347 - RNA, 22 nt, Artificial Sequence
  Synthetic
gguggaggagggagggaggagu

SEQ ID NO: 14348 - RNA, 23 nt, Artificial Sequence
  Synthetic
agguggaggagggagggaggagu

SEQ ID NO: 14349 - RNA, 24 nt, Artificial Sequence
  Synthetic
aagguggaggagggagggaggagu

SEQ ID NO: 14350 - RNA, 18 nt, Artificial Sequence
  Synthetic
ggcagauagagagggagu

SEQ ID NO: 14351 - RNA, 19 nt, Artificial Sequence
  Synthetic
aggcagauagagagggagu

SEQ ID NO: 14352 - RNA, 20 nt, Artificial Sequence
  Synthetic
aaggcagauagagagggagu

SEQ ID NO: 14353 - RNA, 21 nt, Artificial Sequence
  Synthetic
gaaggcagauagagagggagu

SEQ ID NO: 14354 - RNA, 22 nt, Artificial Sequence
  Synthetic
agaaggcagauagagagggagu

SEQ ID NO: 14355 - RNA, 23 nt, Artificial Sequence
  Synthetic
cagaaggcagauagagagggagu

SEQ ID NO: 14356 - RNA, 24 nt, Artificial Sequence
  Synthetic
acagaaggcagauagagagggagu

SEQ ID NO: 14357 - RNA, 18 nt, Artificial Sequence
  Synthetic
cagccgcaaccugggagu

SEQ ID NO: 14358 - RNA, 19 nt, Artificial Sequence
  Synthetic
ccagccgcaaccugggagu

SEQ ID NO: 14359 - RNA, 21 nt, Artificial Sequence
  Synthetic
guccagccgcaaccugggagu

SEQ ID NO: 14360 - RNA, 22 nt, Artificial Sequence
  Synthetic
aguccagccgcaaccugggagu

SEQ ID NO: 14361 - RNA, 23 nt, Artificial Sequence
  Synthetic
caguccagccgcaaccugggagu

SEQ ID NO: 14362 - RNA, 24 nt, Artificial Sequence
  Synthetic
ccaguccagccgcaaccugggagu

SEQ ID NO: 14363 - RNA, 18 nt, Artificial Sequence
  Synthetic
cgggcucugugugggagu

SEQ ID NO: 14364 - RNA, 19 nt, Artificial Sequence
  Synthetic
acgggcucugugugggagu

SEQ ID NO: 14365 - RNA, 20 nt, Artificial Sequence
  Synthetic
cacgggcucugugugggagu

SEQ ID NO: 14366 - RNA, 21 nt, Artificial Sequence
  Synthetic
ccacgggcucugugugggagu

SEQ ID NO: 14367 - RNA, 22 nt, Artificial Sequence
  Synthetic
uccacgggcucugugugggagu

SEQ ID NO: 14368 - RNA, 23 nt, Artificial Sequence
  Synthetic
auccacgggcucugugugggagu

SEQ ID NO: 14369 - RNA, 24 nt, Artificial Sequence
  Synthetic
aauccacgggcucugugugggagu

SEQ ID NO: 14370 - RNA, 18 nt, Artificial Sequence
  Synthetic
gccuccuguggggcccgu

SEQ ID NO: 14371 - RNA, 19 nt, Artificial Sequence
  Synthetic
ugccuccuguggggcccgu

SEQ ID NO: 14372 - RNA, 20 nt, Artificial Sequence
  Synthetic
cugccuccuguggggcccgu

SEQ ID NO: 14373 - RNA, 21 nt, Artificial Sequence
  Synthetic
gcugccuccuguggggcccgu

SEQ ID NO: 14374 - RNA, 22 nt, Artificial Sequence
  Synthetic
ggcugccuccuguggggcccgu

SEQ ID NO: 14375 - RNA, 23 nt, Artificial Sequence
  Synthetic
gggcugccuccuguggggcccgu

SEQ ID NO: 14376 - RNA, 24 nt, Artificial Sequence
  Synthetic
ugggcugccuccuguggggcccgu

SEQ ID NO: 14377 - RNA, 18 nt, Artificial Sequence
  Synthetic
cccgggucuggacaaggu

SEQ ID NO: 14378 - RNA, 19 nt, Artificial Sequence
  Synthetic
ucccgggucuggacaaggu

SEQ ID NO: 14379 - RNA, 21 nt, Artificial Sequence
  Synthetic
ccucccgggucuggacaaggu

SEQ ID NO: 14380 - RNA, 22 nt, Artificial Sequence
  Synthetic
cccucccgggucuggacaaggu

SEQ ID NO: 14381 - RNA, 23 nt, Artificial Sequence
  Synthetic
ccccucccgggucuggacaaggu

SEQ ID NO: 14382 - RNA, 24 nt, Artificial Sequence
  Synthetic
gccccucccgggucuggacaaggu

SEQ ID NO: 14383 - RNA, 18 nt, Artificial Sequence
  Synthetic
ccgcugcaccugucaggu

SEQ ID NO: 14384 - RNA, 19 nt, Artificial Sequence
  Synthetic
gccgcugcaccugucaggu

SEQ ID NO: 14385 - RNA, 20 nt, Artificial Sequence
  Synthetic
ggccgcugcaccugucaggu

SEQ ID NO: 14386 - RNA, 21 nt, Artificial Sequence
  Synthetic
aggccgcugcaccugucaggu

SEQ ID NO: 14387 - RNA, 22 nt, Artificial Sequence
  Synthetic
caggccgcugcaccugucaggu

SEQ ID NO: 14388 - RNA, 23 nt, Artificial Sequence
  Synthetic
ccaggccgcugcaccugucaggu

SEQ ID NO: 14389 - RNA, 24 nt, Artificial Sequence
  Synthetic
gccaggccgcugcaccugucaggu

SEQ ID NO: 14390 - RNA, 18 nt, Artificial Sequence
  Synthetic
caggacacagcucgaggu

SEQ ID NO: 14391 - RNA, 19 nt, Artificial Sequence
  Synthetic
ucaggacacagcucgaggu

SEQ ID NO: 14392 - RNA, 20 nt, Artificial Sequence
  Synthetic
aucaggacacagcucgaggu

SEQ ID NO: 14393 - RNA, 21 nt, Artificial Sequence
  Synthetic
aaucaggacacagcucgaggu

SEQ ID NO: 14394 - RNA, 22 nt, Artificial Sequence
  Synthetic
gaaucaggacacagcucgaggu

SEQ ID NO: 14395 - RNA, 23 nt, Artificial Sequence
  Synthetic
agaaucaggacacagcucgaggu

SEQ ID NO: 14396 - RNA, 24 nt, Artificial Sequence
  Synthetic
cagaaucaggacacagcucgaggu

SEQ ID NO: 14397 - RNA, 18 nt, Artificial Sequence
  Synthetic
ccugggccccucccgggu

SEQ ID NO: 14398 - RNA, 19 nt, Artificial Sequence
  Synthetic
accugggccccucccgggu

SEQ ID NO: 14399 - RNA, 20 nt, Artificial Sequence
  Synthetic
caccugggccccucccgggu

SEQ ID NO: 14400 - RNA, 21 nt, Artificial Sequence
  Synthetic
ucaccugggccccucccgggu

SEQ ID NO: 14401 - RNA, 22 nt, Artificial Sequence
  Synthetic
uucaccugggccccucccgggu

SEQ ID NO: 14402 - RNA, 23 nt, Artificial Sequence
  Synthetic
cuucaccugggccccucccgggu

SEQ ID NO: 14403 - RNA, 24 nt, Artificial Sequence
  Synthetic
gcuucaccugggccccucccgggu

SEQ ID NO: 14404 - RNA, 18 nt, Artificial Sequence
  Synthetic
gaggaccaugcccaaugu

SEQ ID NO: 14405 - RNA, 19 nt, Artificial Sequence
  Synthetic
ggaggaccaugcccaaugu

SEQ ID NO: 14406 - RNA, 20 nt, Artificial Sequence
  Synthetic
gggaggaccaugcccaaugu

SEQ ID NO: 14407 - RNA, 21 nt, Artificial Sequence
  Synthetic
agggaggaccaugcccaaugu

SEQ ID NO: 14408 - RNA, 22 nt, Artificial Sequence
  Synthetic
cagggaggaccaugcccaaugu

SEQ ID NO: 14409 - RNA, 23 nt, Artificial Sequence
  Synthetic
gcagggaggaccaugcccaaugu

SEQ ID NO: 14410 - RNA, 24 nt, Artificial Sequence
  Synthetic
ugcagggaggaccaugcccaaugu

SEQ ID NO: 14411 - RNA, 18 nt, Artificial Sequence
  Synthetic
cgaauccacgggcucugu

SEQ ID NO: 14412 - RNA, 19 nt, Artificial Sequence
  Synthetic
acgaauccacgggcucugu

SEQ ID NO: 14413 - RNA, 20 nt, Artificial Sequence
  Synthetic
gacgaauccacgggcucugu

SEQ ID NO: 14414 - RNA, 21 nt, Artificial Sequence
  Synthetic
agacgaauccacgggcucugu

SEQ ID NO: 14415 - RNA, 22 nt, Artificial Sequence
  Synthetic
cagacgaauccacgggcucugu

SEQ ID NO: 14416 - RNA, 23 nt, Artificial Sequence
  Synthetic
gcagacgaauccacgggcucugu

SEQ ID NO: 14417 - RNA, 24 nt, Artificial Sequence
  Synthetic
agcagacgaauccacgggcucugu

SEQ ID NO: 14418 - RNA, 18 nt, Artificial Sequence
  Synthetic
ugagaucugcacuuuugu

SEQ ID NO: 14419 - RNA, 19 nt, Artificial Sequence
  Synthetic
cugagaucugcacuuuugu

SEQ ID NO: 14420 - RNA, 20 nt, Artificial Sequence
  Synthetic
ucugagaucugcacuuuugu

SEQ ID NO: 14421 - RNA, 21 nt, Artificial Sequence
  Synthetic
aucugagaucugcacuuuugu

SEQ ID NO: 14422 - RNA, 22 nt, Artificial Sequence
  Synthetic
aaucugagaucugcacuuuugu

SEQ ID NO: 14423 - RNA, 23 nt, Artificial Sequence
  Synthetic
aaaucugagaucugcacuuuugu

SEQ ID NO: 14424 - RNA, 24 nt, Artificial Sequence
  Synthetic
gaaaucugagaucugcacuuuugu

SEQ ID NO: 14425 - RNA, 18 nt, Artificial Sequence
  Synthetic
uaaguuuggaaagagauu

SEQ ID NO: 14426 - RNA, 19 nt, Artificial Sequence
  Synthetic
uuaaguuuggaaagagauu

SEQ ID NO: 14427 - RNA, 20 nt, Artificial Sequence
  Synthetic
auuaaguuuggaaagagauu

SEQ ID NO: 14428 - RNA, 21 nt, Artificial Sequence
  Synthetic
cauuaaguuuggaaagagauu

SEQ ID NO: 14429 - RNA, 22 nt, Artificial Sequence
  Synthetic
gcauuaaguuuggaaagagauu

SEQ ID NO: 14430 - RNA, 23 nt, Artificial Sequence
  Synthetic
ugcauuaaguuuggaaagagauu

SEQ ID NO: 14431 - RNA, 24 nt, Artificial Sequence
  Synthetic
cugcauuaaguuuggaaagagauu

SEQ ID NO: 14432 - RNA, 18 nt, Artificial Sequence
  Synthetic
gaaaacugauuuauccuu

SEQ ID NO: 14433 - RNA, 19 nt, Artificial Sequence
  Synthetic
agaaaacugauuuauccuu

SEQ ID NO: 14434 - RNA, 21 nt, Artificial Sequence
  Synthetic
ucagaaaacugauuuauccuu

SEQ ID NO: 14435 - RNA, 22 nt, Artificial Sequence
  Synthetic
cucagaaaacugauuuauccuu

SEQ ID NO: 14436 - RNA, 23 nt, Artificial Sequence
  Synthetic
ccucagaaaacugauuuauccuu

SEQ ID NO: 14437 - RNA, 24 nt, Artificial Sequence
  Synthetic
accucagaaaacugauuuauccuu

SEQ ID NO: 14438 - RNA, 18 nt, Artificial Sequence
  Synthetic
cgggagcccuccuuccuu

SEQ ID NO: 14439 - RNA, 19 nt, Artificial Sequence
  Synthetic
ucgggagcccuccuuccuu

SEQ ID NO: 14440 - RNA, 21 nt, Artificial Sequence
  Synthetic
ccucgggagcccuccuuccuu

SEQ ID NO: 14441 - RNA, 22 nt, Artificial Sequence
  Synthetic
cccucgggagcccuccuuccuu

SEQ ID NO: 14442 - RNA, 23 nt, Artificial Sequence
  Synthetic
gcccucgggagcccuccuuccuu

SEQ ID NO: 14443 - RNA, 24 nt, Artificial Sequence
  Synthetic
ugcccucgggagcccuccuuccuu

SEQ ID NO: 14444 - RNA, 18 nt, Artificial Sequence
  Synthetic
gccuuugucugcuggcuu

SEQ ID NO: 14445 - RNA, 19 nt, Artificial Sequence
  Synthetic
ggccuuugucugcuggcuu

SEQ ID NO: 14446 - RNA, 20 nt, Artificial Sequence
  Synthetic
gggccuuugucugcuggcuu

SEQ ID NO: 14447 - RNA, 21 nt, Artificial Sequence
  Synthetic
ugggccuuugucugcuggcuu

SEQ ID NO: 14448 - RNA, 22 nt, Artificial Sequence
  Synthetic
cugggccuuugucugcuggcuu

SEQ ID NO: 14449 - RNA, 23 nt, Artificial Sequence
  Synthetic
gcugggccuuugucugcuggcuu

SEQ ID NO: 14450 - RNA, 24 nt, Artificial Sequence
  Synthetic
ggcugggccuuugucugcuggcuu

SEQ ID NO: 14451 - RNA, 18 nt, Artificial Sequence
  Synthetic
cuuuugcugcauuaaguu

SEQ ID NO: 14452 - RNA, 19 nt, Artificial Sequence
  Synthetic
ccuuuugcugcauuaaguu

SEQ ID NO: 14453 - RNA, 21 nt, Artificial Sequence
  Synthetic
auccuuuugcugcauuaaguu

SEQ ID NO: 14454 - RNA, 22 nt, Artificial Sequence
  Synthetic
uauccuuuugcugcauuaaguu

SEQ ID NO: 14455 - RNA, 23 nt, Artificial Sequence
  Synthetic
uuauccuuuugcugcauuaaguu

SEQ ID NO: 14456 - RNA, 24 nt, Artificial Sequence
  Synthetic
cuuauccuuuugcugcauuaaguu

SEQ ID NO: 14457 - RNA, 18 nt, Artificial Sequence
  Synthetic
aaguuuggaaagagauuu

SEQ ID NO: 14458 - RNA, 19 nt, Artificial Sequence
  Synthetic
uaaguuuggaaagagauuu

SEQ ID NO: 14459 - RNA, 21 nt, Artificial Sequence
  Synthetic
auuaaguuuggaaagagauuu

SEQ ID NO: 14460 - RNA, 22 nt, Artificial Sequence
  Synthetic
cauuaaguuuggaaagagauuu

SEQ ID NO: 14461 - RNA, 23 nt, Artificial Sequence
  Synthetic
gcauuaaguuuggaaagagauuu

SEQ ID NO: 14462 - RNA, 24 nt, Artificial Sequence
  Synthetic
ugcauuaaguuuggaaagagauuu

SEQ ID NO: 14463 - RNA, 18 nt, Artificial Sequence
  Synthetic
gacaccggcuuucacuuu

SEQ ID NO: 14464 - RNA, 19 nt, Artificial Sequence
  Synthetic
ugacaccggcuuucacuuu

SEQ ID NO: 14465 - RNA, 20 nt, Artificial Sequence
  Synthetic
uugacaccggcuuucacuuu

SEQ ID NO: 14466 - RNA, 21 nt, Artificial Sequence
  Synthetic
guugacaccggcuuucacuuu

SEQ ID NO: 14467 - RNA, 22 nt, Artificial Sequence
  Synthetic
gguugacaccggcuuucacuuu

SEQ ID NO: 14468 - RNA, 23 nt, Artificial Sequence
  Synthetic
ugguugacaccggcuuucacuuu

SEQ ID NO: 14469 - RNA, 24 nt, Artificial Sequence
  Synthetic
cugguugacaccggcuuucacuuu

SEQ ID NO: 14470 - RNA, 18 nt, Artificial Sequence
  Synthetic
aggcagggaggugcuuuu

SEQ ID NO: 14471 - RNA, 19 nt, Artificial Sequence
  Synthetic
aaggcagggaggugcuuuu

SEQ ID NO: 14472 - RNA, 20 nt, Artificial Sequence
  Synthetic
aaaggcagggaggugcuuuu

SEQ ID NO: 14473 - RNA, 21 nt, Artificial Sequence
  Synthetic
aaaaggcagggaggugcuuuu

SEQ ID NO: 14474 - RNA, 22 nt, Artificial Sequence
  Synthetic
gaaaaggcagggaggugcuuuu

SEQ ID NO: 14475 - RNA, 23 nt, Artificial Sequence
  Synthetic
agaaaaggcagggaggugcuuuu

SEQ ID NO: 14476 - RNA, 24 nt, Artificial Sequence
  Synthetic
uagaaaaggcagggaggugcuuuu

SEQ ID NO: 14477 - RNA, 20 nt, Artificial Sequence
  Synthetic
gccuggucugggcugagcca

SEQ ID NO: 14478 - RNA, 18 nt, Artificial Sequence
  Synthetic
gugagcucuaccugggac

SEQ ID NO: 14479 - RNA, 21 nt, Artificial Sequence
  Synthetic
gcagugagcucuaccugggac

SEQ ID NO: 14480 - RNA, 22 nt, Artificial Sequence
  Synthetic
gaucaugcacuauccucuaggc

SEQ ID NO: 14481 - RNA, 23 nt, Artificial Sequence
  Synthetic
ggaucaugcacuauccucuaggc

SEQ ID NO: 14482 - RNA, 19 nt, Artificial Sequence
  Synthetic
gugacccugccacguccug

SEQ ID NO: 14483 - RNA, 20 nt, Artificial Sequence
  Synthetic
ggugacccugccacguccug

SEQ ID NO: 14484 - RNA, 22 nt, Artificial Sequence
  Synthetic
guggugacccugccacguccug

SEQ ID NO: 14485 - RNA, 23 nt, Artificial Sequence
  Synthetic
gguggugacccugccacguccug

SEQ ID NO: 14486 - RNA, 24 nt, Artificial Sequence
  Synthetic
ggguggugacccugccacguccug

SEQ ID NO: 14487 - RNA, 19 nt, Artificial Sequence
  Synthetic
gccacguccugccggguau

SEQ ID NO: 14488 - RNA, 19 nt, Artificial Sequence
  Synthetic
gcugcuguacuccagccua

SEQ ID NO: 14489 - RNA, 20 nt, Artificial Sequence
  Synthetic
guucuagcccgcuccagguc

SEQ ID NO: 14490 - RNA, 24 nt, Artificial Sequence
  Synthetic
gccuguucuagcccgcuccagguc

SEQ ID NO: 14491 - RNA, 18 nt, Artificial Sequence
  Synthetic
gcgccuggaagggugguc

SEQ ID NO: 14492 - RNA, 22 nt, Artificial Sequence
  Synthetic
gccugcgccuggaagggugguc

SEQ ID NO: 14493 - RNA, 24 nt, Artificial Sequence
  Synthetic
gugccugcgccuggaagggugguc

SEQ ID NO: 14494 - RNA, 20 nt, Artificial Sequence
  Synthetic
gcaggcagagccucagaccu

SEQ ID NO: 14495 - RNA, 21 nt, Artificial Sequence
  Synthetic
ggcaggcagagccucagaccu

SEQ ID NO: 14496 - RNA, 22 nt, Artificial Sequence
  Synthetic
gggcaggcagagccucagaccu

SEQ ID NO: 14497 - RNA, 18 nt, Artificial Sequence
  Synthetic
cuggucugggcugagcca

SEQ ID NO: 14498 - RNA, 19 nt, Artificial Sequence
  Synthetic
ccuggucugggcugagcca

SEQ ID NO: 14499 - RNA, 21 nt, Artificial Sequence
  Synthetic
ugccuggucugggcugagcca

SEQ ID NO: 14500 - RNA, 22 nt, Artificial Sequence
  Synthetic
augccuggucugggcugagcca

SEQ ID NO: 14501 - RNA, 23 nt, Artificial Sequence
  Synthetic
aaugccuggucugggcugagcca

SEQ ID NO: 14502 - RNA, 24 nt, Artificial Sequence
  Synthetic
caaugccuggucugggcugagcca

SEQ ID NO: 14503 - RNA, 18 nt, Artificial Sequence
  Synthetic
ucuuauuuaucuuagaga

SEQ ID NO: 14504 - RNA, 19 nt, Artificial Sequence
  Synthetic
uucuuauuuaucuuagaga

SEQ ID NO: 14505 - RNA, 20 nt, Artificial Sequence
  Synthetic
uuucuuauuuaucuuagaga

SEQ ID NO: 14506 - RNA, 21 nt, Artificial Sequence
  Synthetic
uuuucuuauuuaucuuagaga

SEQ ID NO: 14507 - RNA, 22 nt, Artificial Sequence
  Synthetic
auuuucuuauuuaucuuagaga

SEQ ID NO: 14508 - RNA, 23 nt, Artificial Sequence
  Synthetic
uauuuucuuauuuaucuuagaga

SEQ ID NO: 14509 - RNA, 24 nt, Artificial Sequence
  Synthetic
uuauuuucuuauuuaucuuagaga

SEQ ID NO: 14510 - RNA, 19 nt, Artificial Sequence
  Synthetic
agugagcucuaccugggac

SEQ ID NO: 14511 - RNA, 22 nt, Artificial Sequence
  Synthetic
agcagugagcucuaccugggac

SEQ ID NO: 14512 - RNA, 23 nt, Artificial Sequence
  Synthetic
cagcagugagcucuaccugggac

SEQ ID NO: 14513 - RNA, 24 nt, Artificial Sequence
  Synthetic
ccagcagugagcucuaccugggac

SEQ ID NO: 14514 - RNA, 18 nt, Artificial Sequence
  Synthetic
augcacuauccucuaggc

SEQ ID NO: 14515 - RNA, 19 nt, Artificial Sequence
  Synthetic
caugcacuauccucuaggc

SEQ ID NO: 14516 - RNA, 21 nt, Artificial Sequence
  Synthetic
aucaugcacuauccucuaggc

SEQ ID NO: 14517 - RNA, 24 nt, Artificial Sequence
  Synthetic
aggaucaugcacuauccucuaggc

SEQ ID NO: 14518 - RNA, 18 nt, Artificial Sequence
  Synthetic
ugacccugccacguccug

SEQ ID NO: 14519 - RNA, 21 nt, Artificial Sequence
  Synthetic
uggugacccugccacguccug

SEQ ID NO: 14520 - RNA, 18 nt, Artificial Sequence
  Synthetic
ccacguccugccggguau

SEQ ID NO: 14521 - RNA, 21 nt, Artificial Sequence
  Synthetic
cugccacguccugccggguau

SEQ ID NO: 14522 - RNA, 22 nt, Artificial Sequence
  Synthetic
ccugccacguccugccggguau

SEQ ID NO: 14523 - RNA, 23 nt, Artificial Sequence
  Synthetic
cccugccacguccugccggguau

SEQ ID NO: 14524 - RNA, 24 nt, Artificial Sequence
  Synthetic
acccugccacguccugccggguau

SEQ ID NO: 14525 - RNA, 18 nt, Artificial Sequence
  Synthetic
cugcuguacuccagccua

SEQ ID NO: 14526 - RNA, 20 nt, Artificial Sequence
  Synthetic
ugcugcuguacuccagccua

SEQ ID NO: 14527 - RNA, 21 nt, Artificial Sequence
  Synthetic
augcugcuguacuccagccua

SEQ ID NO: 14528 - RNA, 22 nt, Artificial Sequence
  Synthetic
caugcugcuguacuccagccua

SEQ ID NO: 14529 - RNA, 23 nt, Artificial Sequence
  Synthetic
ucaugcugcuguacuccagccua

SEQ ID NO: 14530 - RNA, 24 nt, Artificial Sequence
  Synthetic
aucaugcugcuguacuccagccua

SEQ ID NO: 14531 - RNA, 18 nt, Artificial Sequence
  Synthetic
ucuagcccgcuccagguc

SEQ ID NO: 14532 - RNA, 19 nt, Artificial Sequence
  Synthetic
uucuagcccgcuccagguc

SEQ ID NO: 14533 - RNA, 21 nt, Artificial Sequence
  Synthetic
uguucuagcccgcuccagguc

SEQ ID NO: 14534 - RNA, 22 nt, Artificial Sequence
  Synthetic
cuguucuagcccgcuccagguc

SEQ ID NO: 14535 - RNA, 23 nt, Artificial Sequence
  Synthetic
ccuguucuagcccgcuccagguc

SEQ ID NO: 14536 - RNA, 19 nt, Artificial Sequence
  Synthetic
ugcgccuggaagggugguc

SEQ ID NO: 14537 - RNA, 20 nt, Artificial Sequence
  Synthetic
cugcgccuggaagggugguc

SEQ ID NO: 14538 - RNA, 21 nt, Artificial Sequence
  Synthetic
ccugcgccuggaagggugguc

SEQ ID NO: 14539 - RNA, 23 nt, Artificial Sequence
  Synthetic
ugccugcgccuggaagggugguc

SEQ ID NO: 14540 - RNA, 18 nt, Artificial Sequence
  Synthetic
ccuggugccugcgccugg

SEQ ID NO: 14541 - RNA, 19 nt, Artificial Sequence
  Synthetic
cccuggugccugcgccugg

SEQ ID NO: 14542 - RNA, 20 nt, Artificial Sequence
  Synthetic
ucccuggugccugcgccugg

SEQ ID NO: 14543 - RNA, 21 nt, Artificial Sequence
  Synthetic
uucccuggugccugcgccugg

SEQ ID NO: 14544 - RNA, 22 nt, Artificial Sequence
  Synthetic
cuucccuggugccugcgccugg

SEQ ID NO: 14545 - RNA, 23 nt, Artificial Sequence
  Synthetic
ccuucccuggugccugcgccugg

SEQ ID NO: 14546 - RNA, 24 nt, Artificial Sequence
  Synthetic
cccuucccuggugccugcgccugg

SEQ ID NO: 14547 - RNA, 18 nt, Artificial Sequence
  Synthetic
auacccggcaggacgugg

SEQ ID NO: 14548 - RNA, 19 nt, Artificial Sequence
  Synthetic
cauacccggcaggacgugg

SEQ ID NO: 14549 - RNA, 20 nt, Artificial Sequence
  Synthetic
ccauacccggcaggacgugg

SEQ ID NO: 14550 - RNA, 21 nt, Artificial Sequence
  Synthetic
cccauacccggcaggacgugg

SEQ ID NO: 14551 - RNA, 22 nt, Artificial Sequence
  Synthetic
ucccauacccggcaggacgugg

SEQ ID NO: 14552 - RNA, 23 nt, Artificial Sequence
  Synthetic
cucccauacccggcaggacgugg

SEQ ID NO: 14553 - RNA, 24 nt, Artificial Sequence
  Synthetic
acucccauacccggcaggacgugg

SEQ ID NO: 14554 - RNA, 18 nt, Artificial Sequence
  Synthetic
aggcagagccucagaccu

SEQ ID NO: 14555 - RNA, 19 nt, Artificial Sequence
  Synthetic
caggcagagccucagaccu

SEQ ID NO: 14556 - RNA, 23 nt, Artificial Sequence
  Synthetic
ugggcaggcagagccucagaccu

SEQ ID NO: 14557 - RNA, 24 nt, Artificial Sequence
  Synthetic
cugggcaggcagagccucagaccu

SEQ ID NO: 14558 - RNA, 18 nt, Artificial Sequence
  Synthetic
uugguguugugaggaaaa

SEQ ID NO: 14559 - RNA, 19 nt, Artificial Sequence
  Synthetic
cuugguguugugaggaaaa

SEQ ID NO: 14560 - RNA, 20 nt, Artificial Sequence
  Synthetic
gcuugguguugugaggaaaa

SEQ ID NO: 14561 - RNA, 21 nt, Artificial Sequence
  Synthetic
ggcuugguguugugaggaaaa

SEQ ID NO: 14562 - RNA, 22 nt, Artificial Sequence
  Synthetic
aggcuugguguugugaggaaaa

SEQ ID NO: 14563 - RNA, 23 nt, Artificial Sequence
  Synthetic
caggcuugguguugugaggaaaa

SEQ ID NO: 14564 - RNA, 24 nt, Artificial Sequence
  Synthetic
acaggcuugguguugugaggaaaa

SEQ ID NO: 14565 - RNA, 18 nt, Artificial Sequence
  Synthetic
uuccuuucccuccccaaa

SEQ ID NO: 14566 - RNA, 19 nt, Artificial Sequence
  Synthetic
cuuccuuucccuccccaaa

SEQ ID NO: 14567 - RNA, 21 nt, Artificial Sequence
  Synthetic
cccuuccuuucccuccccaaa

SEQ ID NO: 14568 - RNA, 22 nt, Artificial Sequence
  Synthetic
ccccuuccuuucccuccccaaa

SEQ ID NO: 14569 - RNA, 23 nt, Artificial Sequence
  Synthetic
uccccuuccuuucccuccccaaa

SEQ ID NO: 14570 - RNA, 24 nt, Artificial Sequence
  Synthetic
guccccuuccuuucccuccccaaa

SEQ ID NO: 14571 - RNA, 18 nt, Artificial Sequence
  Synthetic
cuuccuuucccuccccaa

SEQ ID NO: 14572 - RNA, 19 nt, Artificial Sequence
  Synthetic
ccuuccuuucccuccccaa

SEQ ID NO: 14573 - RNA, 21 nt, Artificial Sequence
  Synthetic
ccccuuccuuucccuccccaa

SEQ ID NO: 14574 - RNA, 22 nt, Artificial Sequence
  Synthetic
uccccuuccuuucccuccccaa

SEQ ID NO: 14575 - RNA, 23 nt, Artificial Sequence
  Synthetic
guccccuuccuuucccuccccaa

SEQ ID NO: 14576 - RNA, 24 nt, Artificial Sequence
  Synthetic
aguccccuuccuuucccuccccaa

SEQ ID NO: 14577 - RNA, 18 nt, Artificial Sequence
  Synthetic
uuccaggcgcaggcacca

SEQ ID NO: 14578 - RNA, 19 nt, Artificial Sequence
  Synthetic
cuuccaggcgcaggcacca

SEQ ID NO: 14579 - RNA, 21 nt, Artificial Sequence
  Synthetic
cccuuccaggcgcaggcacca

SEQ ID NO: 14580 - RNA, 22 nt, Artificial Sequence
  Synthetic
acccuuccaggcgcaggcacca

SEQ ID NO: 14581 - RNA, 23 nt, Artificial Sequence
  Synthetic
cacccuuccaggcgcaggcacca

SEQ ID NO: 14582 - RNA, 24 nt, Artificial Sequence
  Synthetic
ccacccuuccaggcgcaggcacca

SEQ ID NO: 14583 - RNA, 18 nt, Artificial Sequence
  Synthetic
ccuuccuuucccucccca

SEQ ID NO: 14584 - RNA, 19 nt, Artificial Sequence
  Synthetic
cccuuccuuucccucccca

SEQ ID NO: 14585 - RNA, 20 nt, Artificial Sequence
  Synthetic
ccccuuccuuucccucccca

SEQ ID NO: 14586 - RNA, 21 nt, Artificial Sequence
  Synthetic
uccccuuccuuucccucccca

SEQ ID NO: 14587 - RNA, 22 nt, Artificial Sequence
  Synthetic
guccccuuccuuucccucccca

SEQ ID NO: 14588 - RNA, 23 nt, Artificial Sequence
  Synthetic
aguccccuuccuuucccucccca

SEQ ID NO: 14589 - RNA, 24 nt, Artificial Sequence
  Synthetic
uaguccccuuccuuucccucccca

SEQ ID NO: 14590 - RNA, 18 nt, Artificial Sequence
  Synthetic
ugaggcucugccugccca

SEQ ID NO: 14591 - RNA, 19 nt, Artificial Sequence
  Synthetic
cugaggcucugccugccca

SEQ ID NO: 14592 - RNA, 20 nt, Artificial Sequence
  Synthetic
ucugaggcucugccugccca

SEQ ID NO: 14593 - RNA, 21 nt, Artificial Sequence
  Synthetic
gucugaggcucugccugccca

SEQ ID NO: 14594 - RNA, 22 nt, Artificial Sequence
  Synthetic
ggucugaggcucugccugccca

SEQ ID NO: 14595 - RNA, 23 nt, Artificial Sequence
  Synthetic
aggucugaggcucugccugccca

SEQ ID NO: 14596 - RNA, 24 nt, Artificial Sequence
  Synthetic
caggucugaggcucugccugccca

SEQ ID NO: 14597 - RNA, 18 nt, Artificial Sequence
  Synthetic
ggcaccagggaaggggca

SEQ ID NO: 14598 - RNA, 19 nt, Artificial Sequence
  Synthetic
aggcaccagggaaggggca

SEQ ID NO: 14599 - RNA, 20 nt, Artificial Sequence
  Synthetic
caggcaccagggaaggggca

SEQ ID NO: 14600 - RNA, 21 nt, Artificial Sequence
  Synthetic
gcaggcaccagggaaggggca

SEQ ID NO: 14601 - RNA, 22 nt, Artificial Sequence
  Synthetic
cgcaggcaccagggaaggggca

SEQ ID NO: 14602 - RNA, 23 nt, Artificial Sequence
  Synthetic
gcgcaggcaccagggaaggggca

SEQ ID NO: 14603 - RNA, 24 nt, Artificial Sequence
  Synthetic
ggcgcaggcaccagggaaggggca

SEQ ID NO: 14604 - RNA, 18 nt, Artificial Sequence
  Synthetic
aggcgcaggcaccaggga

SEQ ID NO: 14605 - RNA, 19 nt, Artificial Sequence
  Synthetic
caggcgcaggcaccaggga

SEQ ID NO: 14606 - RNA, 21 nt, Artificial Sequence
  Synthetic
uccaggcgcaggcaccaggga

SEQ ID NO: 14607 - RNA, 22 nt, Artificial Sequence
  Synthetic
uuccaggcgcaggcaccaggga

SEQ ID NO: 14608 - RNA, 23 nt, Artificial Sequence
  Synthetic
cuuccaggcgcaggcaccaggga

SEQ ID NO: 14609 - RNA, 24 nt, Artificial Sequence
  Synthetic
ccuuccaggcgcaggcaccaggga

SEQ ID NO: 14610 - RNA, 18 nt, Artificial Sequence
  Synthetic
agugagcucuaccuggga

SEQ ID NO: 14611 - RNA, 19 nt, Artificial Sequence
  Synthetic
cagugagcucuaccuggga

SEQ ID NO: 14612 - RNA, 20 nt, Artificial Sequence
  Synthetic
gcagugagcucuaccuggga

SEQ ID NO: 14613 - RNA, 21 nt, Artificial Sequence
  Synthetic
agcagugagcucuaccuggga

SEQ ID NO: 14614 - RNA, 22 nt, Artificial Sequence
  Synthetic
cagcagugagcucuaccuggga

SEQ ID NO: 14615 - RNA, 23 nt, Artificial Sequence
  Synthetic
ccagcagugagcucuaccuggga

SEQ ID NO: 14616 - RNA, 24 nt, Artificial Sequence
  Synthetic
gccagcagugagcucuaccuggga

SEQ ID NO: 14617 - RNA, 18 nt, Artificial Sequence
  Synthetic
cagcauucuagaccugga

SEQ ID NO: 14618 - RNA, 19 nt, Artificial Sequence
  Synthetic
gcagcauucuagaccugga

SEQ ID NO: 14619 - RNA, 20 nt, Artificial Sequence
  Synthetic
ugcagcauucuagaccugga

SEQ ID NO: 14620 - RNA, 21 nt, Artificial Sequence
  Synthetic
cugcagcauucuagaccugga

SEQ ID NO: 14621 - RNA, 22 nt, Artificial Sequence
  Synthetic
gcugcagcauucuagaccugga

SEQ ID NO: 14622 - RNA, 23 nt, Artificial Sequence
  Synthetic
ugcugcagcauucuagaccugga

SEQ ID NO: 14623 - RNA, 24 nt, Artificial Sequence
  Synthetic
gugcugcagcauucuagaccugga

SEQ ID NO: 14624 - RNA, 18 nt, Artificial Sequence
  Synthetic
uauaguucuuuuuuauga

SEQ ID NO: 14625 - RNA, 19 nt, Artificial Sequence
  Synthetic
auauaguucuuuuuuauga

SEQ ID NO: 14626 - RNA, 20 nt, Artificial Sequence
  Synthetic
uauauaguucuuuuuuauga

SEQ ID NO: 14627 - RNA, 21 nt, Artificial Sequence
  Synthetic
auauauaguucuuuuuuauga

SEQ ID NO: 14628 - RNA, 22 nt, Artificial Sequence
  Synthetic
aauauauaguucuuuuuuauga

SEQ ID NO: 14629 - RNA, 23 nt, Artificial Sequence
  Synthetic
aaauauauaguucuuuuuuauga

SEQ ID NO: 14630 - RNA, 24 nt, Artificial Sequence
  Synthetic
aaaauauauaguucuuuuuuauga

SEQ ID NO: 14631 - RNA, 18 nt, Artificial Sequence
  Synthetic
uacaauuuuucagcaaua

SEQ ID NO: 14632 - RNA, 19 nt, Artificial Sequence
  Synthetic
guacaauuuuucagcaaua

SEQ ID NO: 14633 - RNA, 20 nt, Artificial Sequence
  Synthetic
aguacaauuuuucagcaaua

SEQ ID NO: 14634 - RNA, 21 nt, Artificial Sequence
  Synthetic
caguacaauuuuucagcaaua

SEQ ID NO: 14635 - RNA, 22 nt, Artificial Sequence
  Synthetic
acaguacaauuuuucagcaaua

SEQ ID NO: 14636 - RNA, 23 nt, Artificial Sequence
  Synthetic
cacaguacaauuuuucagcaaua

SEQ ID NO: 14637 - RNA, 24 nt, Artificial Sequence
  Synthetic
ucacaguacaauuuuucagcaaua

SEQ ID NO: 14638 - RNA, 18 nt, Artificial Sequence
  Synthetic
cagcaauacagaaguaua

SEQ ID NO: 14639 - RNA, 19 nt, Artificial Sequence
  Synthetic
ucagcaauacagaaguaua

SEQ ID NO: 14640 - RNA, 20 nt, Artificial Sequence
  Synthetic
uucagcaauacagaaguaua

SEQ ID NO: 14641 - RNA, 21 nt, Artificial Sequence
  Synthetic
uuucagcaauacagaaguaua

SEQ ID NO: 14642 - RNA, 22 nt, Artificial Sequence
  Synthetic
uuuucagcaauacagaaguaua

SEQ ID NO: 14643 - RNA, 23 nt, Artificial Sequence
  Synthetic
uuuuucagcaauacagaaguaua

SEQ ID NO: 14644 - RNA, 24 nt, Artificial Sequence
  Synthetic
auuuuucagcaauacagaaguaua

SEQ ID NO: 14645 - RNA, 18 nt, Artificial Sequence
  Synthetic
gccacguccugccgggua

SEQ ID NO: 14646 - RNA, 19 nt, Artificial Sequence
  Synthetic
ugccacguccugccgggua

SEQ ID NO: 14647 - RNA, 21 nt, Artificial Sequence
  Synthetic
ccugccacguccugccgggua

SEQ ID NO: 14648 - RNA, 22 nt, Artificial Sequence
  Synthetic
cccugccacguccugccgggua

SEQ ID NO: 14649 - RNA, 23 nt, Artificial Sequence
  Synthetic
acccugccacguccugccgggua

SEQ ID NO: 14650 - RNA, 24 nt, Artificial Sequence
  Synthetic
gacccugccacguccugccgggua

SEQ ID NO: 14651 - RNA, 18 nt, Artificial Sequence
  Synthetic
ccuuccaggcgcaggcac

SEQ ID NO: 14652 - RNA, 19 nt, Artificial Sequence
  Synthetic
cccuuccaggcgcaggcac

SEQ ID NO: 14653 - RNA, 20 nt, Artificial Sequence
  Synthetic
acccuuccaggcgcaggcac

SEQ ID NO: 14654 - RNA, 21 nt, Artificial Sequence
  Synthetic
cacccuuccaggcgcaggcac

SEQ ID NO: 14655 - RNA, 22 nt, Artificial Sequence
  Synthetic
ccacccuuccaggcgcaggcac

SEQ ID NO: 14656 - RNA, 23 nt, Artificial Sequence
  Synthetic
accacccuuccaggcgcaggcac

SEQ ID NO: 14657 - RNA, 24 nt, Artificial Sequence
  Synthetic
gaccacccuuccaggcgcaggcac

SEQ ID NO: 14658 - RNA, 18 nt, Artificial Sequence
  Synthetic
aaaauagaaaucugagac

SEQ ID NO: 14659 - RNA, 19 nt, Artificial Sequence
  Synthetic
gaaaauagaaaucugagac

SEQ ID NO: 14660 - RNA, 20 nt, Artificial Sequence
  Synthetic
ggaaaauagaaaucugagac

SEQ ID NO: 14661 - RNA, 21 nt, Artificial Sequence
  Synthetic
aggaaaauagaaaucugagac

SEQ ID NO: 14662 - RNA, 22 nt, Artificial Sequence
  Synthetic
gaggaaaauagaaaucugagac

SEQ ID NO: 14663 - RNA, 23 nt, Artificial Sequence
  Synthetic
ugaggaaaauagaaaucugagac

SEQ ID NO: 14664 - RNA, 24 nt, Artificial Sequence
  Synthetic
gugaggaaaauagaaaucugagac

SEQ ID NO: 14665 - RNA, 18 nt, Artificial Sequence
  Synthetic
ugcugcagcauucuagac

SEQ ID NO: 14666 - RNA, 19 nt, Artificial Sequence
  Synthetic
gugcugcagcauucuagac

SEQ ID NO: 14667 - RNA, 20 nt, Artificial Sequence
  Synthetic
agugcugcagcauucuagac

SEQ ID NO: 14668 - RNA, 21 nt, Artificial Sequence
  Synthetic
uagugcugcagcauucuagac

SEQ ID NO: 14669 - RNA, 22 nt, Artificial Sequence
  Synthetic
cuagugcugcagcauucuagac

SEQ ID NO: 14670 - RNA, 23 nt, Artificial Sequence
  Synthetic
ccuagugcugcagcauucuagac

SEQ ID NO: 14671 - RNA, 24 nt, Artificial Sequence
  Synthetic
gccuagugcugcagcauucuagac

SEQ ID NO: 14672 - RNA, 18 nt, Artificial Sequence
  Synthetic
agugagcaccucagcacc

SEQ ID NO: 14673 - RNA, 19 nt, Artificial Sequence
  Synthetic
cagugagcaccucagcacc

SEQ ID NO: 14674 - RNA, 20 nt, Artificial Sequence
  Synthetic
ccagugagcaccucagcacc

SEQ ID NO: 14675 - RNA, 21 nt, Artificial Sequence
  Synthetic
cccagugagcaccucagcacc

SEQ ID NO: 14676 - RNA, 22 nt, Artificial Sequence
  Synthetic
gcccagugagcaccucagcacc

SEQ ID NO: 14677 - RNA, 23 nt, Artificial Sequence
  Synthetic
ugcccagugagcaccucagcacc

SEQ ID NO: 14678 - RNA, 24 nt, Artificial Sequence
  Synthetic
cugcccagugagcaccucagcacc

SEQ ID NO: 14679 - RNA, 18 nt, Artificial Sequence
  Synthetic
cuuccaggcgcaggcacc

SEQ ID NO: 14680 - RNA, 19 nt, Artificial Sequence
  Synthetic
ccuuccaggcgcaggcacc

SEQ ID NO: 14681 - RNA, 21 nt, Artificial Sequence
  Synthetic
acccuuccaggcgcaggcacc

SEQ ID NO: 14682 - RNA, 22 nt, Artificial Sequence
  Synthetic
cacccuuccaggcgcaggcacc

SEQ ID NO: 14683 - RNA, 23 nt, Artificial Sequence
  Synthetic
ccacccuuccaggcgcaggcacc

SEQ ID NO: 14684 - RNA, 24 nt, Artificial Sequence
  Synthetic
accacccuuccaggcgcaggcacc

SEQ ID NO: 14685 - RNA, 18 nt, Artificial Sequence
  Synthetic
gcugcagcauucuagacc

SEQ ID NO: 14686 - RNA, 19 nt, Artificial Sequence
  Synthetic
ugcugcagcauucuagacc

SEQ ID NO: 14687 - RNA, 21 nt, Artificial Sequence
  Synthetic
agugcugcagcauucuagacc

SEQ ID NO: 14688 - RNA, 22 nt, Artificial Sequence
  Synthetic
uagugcugcagcauucuagacc

SEQ ID NO: 14689 - RNA, 23 nt, Artificial Sequence
  Synthetic
cuagugcugcagcauucuagacc

SEQ ID NO: 14690 - RNA, 24 nt, Artificial Sequence
  Synthetic
ccuagugcugcagcauucuagacc

SEQ ID NO: 14691 - RNA, 18 nt, Artificial Sequence
  Synthetic
ccagcagugagcucuacc

SEQ ID NO: 14692 - RNA, 19 nt, Artificial Sequence
  Synthetic
gccagcagugagcucuacc

SEQ ID NO: 14693 - RNA, 18 nt, Artificial Sequence
  Synthetic
ucuagaccuggagcgggc

SEQ ID NO: 14694 - RNA, 19 nt, Artificial Sequence
  Synthetic
uucuagaccuggagcgggc

SEQ ID NO: 14695 - RNA, 20 nt, Artificial Sequence
  Synthetic
auucuagaccuggagcgggc

SEQ ID NO: 14696 - RNA, 21 nt, Artificial Sequence
  Synthetic
cauucuagaccuggagcgggc

SEQ ID NO: 14697 - RNA, 22 nt, Artificial Sequence
  Synthetic
gcauucuagaccuggagcgggc

SEQ ID NO: 14698 - RNA, 23 nt, Artificial Sequence
  Synthetic
agcauucuagaccuggagcgggc

SEQ ID NO: 14699 - RNA, 24 nt, Artificial Sequence
  Synthetic
cagcauucuagaccuggagcgggc

SEQ ID NO: 14700 - RNA, 18 nt, Artificial Sequence
  Synthetic
uccuuucccuccccaaag

SEQ ID NO: 14701 - RNA, 19 nt, Artificial Sequence
  Synthetic
uuccuuucccuccccaaag

SEQ ID NO: 14702 - RNA, 21 nt, Artificial Sequence
  Synthetic
ccuuccuuucccuccccaaag

SEQ ID NO: 14703 - RNA, 22 nt, Artificial Sequence
  Synthetic
cccuuccuuucccuccccaaag

SEQ ID NO: 14704 - RNA, 23 nt, Artificial Sequence
  Synthetic
ccccuuccuuucccuccccaaag

SEQ ID NO: 14705 - RNA, 24 nt, Artificial Sequence
  Synthetic
uccccuuccuuucccuccccaaag

SEQ ID NO: 14706 - RNA, 18 nt, Artificial Sequence
  Synthetic
gcaccagggaaggggcag

SEQ ID NO: 14707 - RNA, 19 nt, Artificial Sequence
  Synthetic
ggcaccagggaaggggcag

SEQ ID NO: 14708 - RNA, 21 nt, Artificial Sequence
  Synthetic
caggcaccagggaaggggcag

SEQ ID NO: 14709 - RNA, 22 nt, Artificial Sequence
  Synthetic
gcaggcaccagggaaggggcag

SEQ ID NO: 14710 - RNA, 23 nt, Artificial Sequence
  Synthetic
cgcaggcaccagggaaggggcag

SEQ ID NO: 14711 - RNA, 24 nt, Artificial Sequence
  Synthetic
gcgcaggcaccagggaaggggcag

SEQ ID NO: 14712 - RNA, 18 nt, Artificial Sequence
  Synthetic
caugcacuauccucuagg

SEQ ID NO: 14713 - RNA, 19 nt, Artificial Sequence
  Synthetic
ucaugcacuauccucuagg

SEQ ID NO: 14714 - RNA, 20 nt, Artificial Sequence
  Synthetic
aucaugcacuauccucuagg

SEQ ID NO: 14715 - RNA, 21 nt, Artificial Sequence
  Synthetic
gaucaugcacuauccucuagg

SEQ ID NO: 14716 - RNA, 22 nt, Artificial Sequence
  Synthetic
ggaucaugcacuauccucuagg

SEQ ID NO: 14717 - RNA, 23 nt, Artificial Sequence
  Synthetic
aggaucaugcacuauccucuagg

SEQ ID NO: 14718 - RNA, 24 nt, Artificial Sequence
  Synthetic
caggaucaugcacuauccucuagg

SEQ ID NO: 14719 - RNA, 18 nt, Artificial Sequence
  Synthetic
caggcgcaggcaccaggg

SEQ ID NO: 14720 - RNA, 19 nt, Artificial Sequence
  Synthetic
ccaggcgcaggcaccaggg

SEQ ID NO: 14721 - RNA, 20 nt, Artificial Sequence
  Synthetic
uccaggcgcaggcaccaggg

SEQ ID NO: 14722 - RNA, 21 nt, Artificial Sequence
  Synthetic
uuccaggcgcaggcaccaggg

SEQ ID NO: 14723 - RNA, 22 nt, Artificial Sequence
  Synthetic
cuuccaggcgcaggcaccaggg

SEQ ID NO: 14724 - RNA, 23 nt, Artificial Sequence
  Synthetic
ccuuccaggcgcaggcaccaggg

SEQ ID NO: 14725 - RNA, 24 nt, Artificial Sequence
  Synthetic
cccuuccaggcgcaggcaccaggg

SEQ ID NO: 14726 - RNA, 18 nt, Artificial Sequence
  Synthetic
caggcaccagggaagggg

SEQ ID NO: 14727 - RNA, 19 nt, Artificial Sequence
  Synthetic
gcaggcaccagggaagggg

SEQ ID NO: 14728 - RNA, 20 nt, Artificial Sequence
  Synthetic
cgcaggcaccagggaagggg

SEQ ID NO: 14729 - RNA, 21 nt, Artificial Sequence
  Synthetic
gcgcaggcaccagggaagggg

SEQ ID NO: 14730 - RNA, 22 nt, Artificial Sequence
  Synthetic
ggcgcaggcaccagggaagggg

SEQ ID NO: 14731 - RNA, 23 nt, Artificial Sequence
  Synthetic
aggcgcaggcaccagggaagggg

SEQ ID NO: 14732 - RNA, 24 nt, Artificial Sequence
  Synthetic
caggcgcaggcaccagggaagggg

SEQ ID NO: 14733 - RNA, 18 nt, Artificial Sequence
  Synthetic
ugcaaugccuggucuggg

SEQ ID NO: 14734 - RNA, 19 nt, Artificial Sequence
  Synthetic
uugcaaugccuggucuggg

SEQ ID NO: 14735 - RNA, 20 nt, Artificial Sequence
  Synthetic
auugcaaugccuggucuggg

SEQ ID NO: 14736 - RNA, 21 nt, Artificial Sequence
  Synthetic
aauugcaaugccuggucuggg

SEQ ID NO: 14737 - RNA, 22 nt, Artificial Sequence
  Synthetic
gaauugcaaugccuggucuggg

SEQ ID NO: 14738 - RNA, 23 nt, Artificial Sequence
  Synthetic
agaauugcaaugccuggucuggg

SEQ ID NO: 14739 - RNA, 24 nt, Artificial Sequence
  Synthetic
aagaauugcaaugccuggucuggg

SEQ ID NO: 14740 - RNA, 18 nt, Artificial Sequence
  Synthetic
aacaggcuugguguugug

SEQ ID NO: 14741 - RNA, 19 nt, Artificial Sequence
  Synthetic
gaacaggcuugguguugug

SEQ ID NO: 14742 - RNA, 21 nt, Artificial Sequence
  Synthetic
uagaacaggcuugguguugug

SEQ ID NO: 14743 - RNA, 22 nt, Artificial Sequence
  Synthetic
cuagaacaggcuugguguugug

SEQ ID NO: 14744 - RNA, 23 nt, Artificial Sequence
  Synthetic
gcuagaacaggcuugguguugug

SEQ ID NO: 14745 - RNA, 24 nt, Artificial Sequence
  Synthetic
ggcuagaacaggcuugguguugug

SEQ ID NO: 14746 - RNA, 18 nt, Artificial Sequence
  Synthetic
ugugaggaaaauagaaau

SEQ ID NO: 14747 - RNA, 19 nt, Artificial Sequence
  Synthetic
uugugaggaaaauagaaau

SEQ ID NO: 14748 - RNA, 20 nt, Artificial Sequence
  Synthetic
guugugaggaaaauagaaau

SEQ ID NO: 14749 - RNA, 21 nt, Artificial Sequence
  Synthetic
uguugugaggaaaauagaaau

SEQ ID NO: 14750 - RNA, 22 nt, Artificial Sequence
  Synthetic
guguugugaggaaaauagaaau

SEQ ID NO: 14751 - RNA, 23 nt, Artificial Sequence
  Synthetic
gguguugugaggaaaauagaaau

SEQ ID NO: 14752 - RNA, 24 nt, Artificial Sequence
  Synthetic
ugguguugugaggaaaauagaaau

SEQ ID NO: 14753 - RNA, 18 nt, Artificial Sequence
  Synthetic
ggguaugggaguggcaau

SEQ ID NO: 14754 - RNA, 19 nt, Artificial Sequence
  Synthetic
cggguaugggaguggcaau

SEQ ID NO: 14755 - RNA, 20 nt, Artificial Sequence
  Synthetic
ccggguaugggaguggcaau

SEQ ID NO: 14756 - RNA, 21 nt, Artificial Sequence
  Synthetic
gccggguaugggaguggcaau

SEQ ID NO: 14757 - RNA, 22 nt, Artificial Sequence
  Synthetic
ugccggguaugggaguggcaau

SEQ ID NO: 14758 - RNA, 23 nt, Artificial Sequence
  Synthetic
cugccggguaugggaguggcaau

SEQ ID NO: 14759 - RNA, 24 nt, Artificial Sequence
  Synthetic
ccugccggguaugggaguggcaau

SEQ ID NO: 14760 - RNA, 18 nt, Artificial Sequence
  Synthetic
uuauuuucuuauuuaucu

SEQ ID NO: 14761 - RNA, 19 nt, Artificial Sequence
  Synthetic
uuuauuuucuuauuuaucu

SEQ ID NO: 14762 - RNA, 20 nt, Artificial Sequence
  Synthetic
uuuuauuuucuuauuuaucu

SEQ ID NO: 14763 - RNA, 21 nt, Artificial Sequence
  Synthetic
cuuuuauuuucuuauuuaucu

SEQ ID NO: 14764 - RNA, 22 nt, Artificial Sequence
  Synthetic
gcuuuuauuuucuuauuuaucu

SEQ ID NO: 14765 - RNA, 23 nt, Artificial Sequence
  Synthetic
ugcuuuuauuuucuuauuuaucu

SEQ ID NO: 14766 - RNA, 24 nt, Artificial Sequence
  Synthetic
uugcuuuuauuuucuuauuuaucu

SEQ ID NO: 14767 - RNA, 18 nt, Artificial Sequence
  Synthetic
caguucccacccucaggu

SEQ ID NO: 14768 - RNA, 19 nt, Artificial Sequence
  Synthetic
ucaguucccacccucaggu

SEQ ID NO: 14769 - RNA, 20 nt, Artificial Sequence
  Synthetic
gucaguucccacccucaggu

SEQ ID NO: 14770 - RNA, 21 nt, Artificial Sequence
  Synthetic
ugucaguucccacccucaggu

SEQ ID NO: 14771 - RNA, 22 nt, Artificial Sequence
  Synthetic
gugucaguucccacccucaggu

SEQ ID NO: 14772 - RNA, 23 nt, Artificial Sequence
  Synthetic
ggugucaguucccacccucaggu

SEQ ID NO: 14773 - RNA, 24 nt, Artificial Sequence
  Synthetic
gggugucaguucccacccucaggu

SEQ ID NO: 14774 - RNA, 18 nt, Artificial Sequence
  Synthetic
ugccacguccugccgggu

SEQ ID NO: 14775 - RNA, 19 nt, Artificial Sequence
  Synthetic
cugccacguccugccgggu

SEQ ID NO: 14776 - RNA, 20 nt, Artificial Sequence
  Synthetic
ccugccacguccugccgggu

SEQ ID NO: 14777 - RNA, 21 nt, Artificial Sequence
  Synthetic
cccugccacguccugccgggu

SEQ ID NO: 14778 - RNA, 22 nt, Artificial Sequence
  Synthetic
acccugccacguccugccgggu

SEQ ID NO: 14779 - RNA, 23 nt, Artificial Sequence
  Synthetic
gacccugccacguccugccgggu

SEQ ID NO: 14780 - RNA, 24 nt, Artificial Sequence
  Synthetic
ugacccugccacguccugccgggu

SEQ ID NO: 14781 - RNA, 18 nt, Artificial Sequence
  Synthetic
agaauugcaaugccuggu

SEQ ID NO: 14782 - RNA, 19 nt, Artificial Sequence
  Synthetic
aagaauugcaaugccuggu

SEQ ID NO: 14783 - RNA, 20 nt, Artificial Sequence
  Synthetic
gaagaauugcaaugccuggu

SEQ ID NO: 14784 - RNA, 21 nt, Artificial Sequence
  Synthetic
agaagaauugcaaugccuggu

SEQ ID NO: 14785 - RNA, 22 nt, Artificial Sequence
  Synthetic
gagaagaauugcaaugccuggu

SEQ ID NO: 14786 - RNA, 23 nt, Artificial Sequence
  Synthetic
ugagaagaauugcaaugccuggu

SEQ ID NO: 14787 - RNA, 24 nt, Artificial Sequence
  Synthetic
gugagaagaauugcaaugccuggu

SEQ ID NO: 14788 - RNA, 18 nt, Artificial Sequence
  Synthetic
ugagaccuggacuuuggu

SEQ ID NO: 14789 - RNA, 19 nt, Artificial Sequence
  Synthetic
cugagaccuggacuuuggu

SEQ ID NO: 14790 - RNA, 20 nt, Artificial Sequence
  Synthetic
ucugagaccuggacuuuggu

SEQ ID NO: 14791 - RNA, 21 nt, Artificial Sequence
  Synthetic
aucugagaccuggacuuuggu

SEQ ID NO: 14792 - RNA, 22 nt, Artificial Sequence
  Synthetic
aaucugagaccuggacuuuggu

SEQ ID NO: 14793 - RNA, 23 nt, Artificial Sequence
  Synthetic
aaaucugagaccuggacuuuggu

SEQ ID NO: 14794 - RNA, 24 nt, Artificial Sequence
  Synthetic
gaaaucugagaccuggacuuuggu

SEQ ID NO: 14795 - RNA, 18 nt, Artificial Sequence
  Synthetic
gaacaggcuugguguugu

SEQ ID NO: 14796 - RNA, 19 nt, Artificial Sequence
  Synthetic
agaacaggcuugguguugu

SEQ ID NO: 14797 - RNA, 20 nt, Artificial Sequence
  Synthetic
uagaacaggcuugguguugu

SEQ ID NO: 14798 - RNA, 21 nt, Artificial Sequence
  Synthetic
cuagaacaggcuugguguugu

SEQ ID NO: 14799 - RNA, 22 nt, Artificial Sequence
  Synthetic
gcuagaacaggcuugguguugu

SEQ ID NO: 14800 - RNA, 23 nt, Artificial Sequence
  Synthetic
ggcuagaacaggcuugguguugu

SEQ ID NO: 14801 - RNA, 24 nt, Artificial Sequence
  Synthetic
gggcuagaacaggcuugguguugu

SEQ ID NO: 14802 - RNA, 18 nt, Artificial Sequence
  Synthetic
uagaacaggcuugguguu

SEQ ID NO: 14803 - RNA, 19 nt, Artificial Sequence
  Synthetic
cuagaacaggcuugguguu

SEQ ID NO: 14804 - RNA, 20 nt, Artificial Sequence
  Synthetic
gcuagaacaggcuugguguu

SEQ ID NO: 14805 - RNA, 21 nt, Artificial Sequence
  Synthetic
ggcuagaacaggcuugguguu

SEQ ID NO: 14806 - RNA, 22 nt, Artificial Sequence
  Synthetic
gggcuagaacaggcuugguguu

SEQ ID NO: 14807 - RNA, 23 nt, Artificial Sequence
  Synthetic
cgggcuagaacaggcuugguguu

SEQ ID NO: 14808 - RNA, 24 nt, Artificial Sequence
  Synthetic
gcgggcuagaacaggcuugguguu

SEQ ID NO: 14809 - RNA, 18 nt, Artificial Sequence
  Synthetic
agaaaauaaaagcaaaaa

SEQ ID NO: 14810 - RNA, 19 nt, Artificial Sequence
  Synthetic
aagaaaauaaaagcaaaaa

SEQ ID NO: 14811 - RNA, 21 nt, Artificial Sequence
  Synthetic
auaagaaaauaaaagcaaaaa

SEQ ID NO: 14812 - RNA, 22 nt, Artificial Sequence
  Synthetic
aauaagaaaauaaaagcaaaaa

SEQ ID NO: 14813 - RNA, 23 nt, Artificial Sequence
  Synthetic
aaauaagaaaauaaaagcaaaaa

SEQ ID NO: 14814 - RNA, 24 nt, Artificial Sequence
  Synthetic
uaaauaagaaaauaaaagcaaaaa

SEQ ID NO: 14815 - RNA, 18 nt, Artificial Sequence
  Synthetic
aagaaaauaaaagcaaaa

SEQ ID NO: 14816 - RNA, 19 nt, Artificial Sequence
  Synthetic
uaagaaaauaaaagcaaaa

SEQ ID NO: 14817 - RNA, 20 nt, Artificial Sequence
  Synthetic
auaagaaaauaaaagcaaaa

SEQ ID NO: 14818 - RNA, 21 nt, Artificial Sequence
  Synthetic
aauaagaaaauaaaagcaaaa

SEQ ID NO: 14819 - RNA, 22 nt, Artificial Sequence
  Synthetic
aaauaagaaaauaaaagcaaaa

SEQ ID NO: 14820 - RNA, 23 nt, Artificial Sequence
  Synthetic
uaaauaagaaaauaaaagcaaaa

SEQ ID NO: 14821 - RNA, 24 nt, Artificial Sequence
  Synthetic
auaaauaagaaaauaaaagcaaaa

SEQ ID NO: 14822 - RNA, 18 nt, Artificial Sequence
  Synthetic
auggucucugucauaaaa

SEQ ID NO: 14823 - RNA, 19 nt, Artificial Sequence
  Synthetic
cauggucucugucauaaaa

SEQ ID NO: 14824 - RNA, 20 nt, Artificial Sequence
  Synthetic
gcauggucucugucauaaaa

SEQ ID NO: 14825 - RNA, 21 nt, Artificial Sequence
  Synthetic
agcauggucucugucauaaaa

SEQ ID NO: 14826 - RNA, 22 nt, Artificial Sequence
  Synthetic
uagcauggucucugucauaaaa

SEQ ID NO: 14827 - RNA, 23 nt, Artificial Sequence
  Synthetic
auagcauggucucugucauaaaa

SEQ ID NO: 14828 - RNA, 24 nt, Artificial Sequence
  Synthetic
uauagcauggucucugucauaaaa

SEQ ID NO: 14829 - RNA, 18 nt, Artificial Sequence
  Synthetic
uaaaagaucaucuuuaaa

SEQ ID NO: 14830 - RNA, 19 nt, Artificial Sequence
  Synthetic
uuaaaagaucaucuuuaaa

SEQ ID NO: 14831 - RNA, 20 nt, Artificial Sequence
  Synthetic
uuuaaaagaucaucuuuaaa

SEQ ID NO: 14832 - RNA, 21 nt, Artificial Sequence
  Synthetic
cuuuaaaagaucaucuuuaaa

SEQ ID NO: 14833 - RNA, 22 nt, Artificial Sequence
  Synthetic
acuuuaaaagaucaucuuuaaa

SEQ ID NO: 14834 - RNA, 23 nt, Artificial Sequence
  Synthetic
cacuuuaaaagaucaucuuuaaa

SEQ ID NO: 14835 - RNA, 24 nt, Artificial Sequence
  Synthetic
acacuuuaaaagaucaucuuuaaa

SEQ ID NO: 14836 - RNA, 18 nt, Artificial Sequence
  Synthetic
uuuggggagggaaaggaa

SEQ ID NO: 14837 - RNA, 19 nt, Artificial Sequence
  Synthetic
cuuuggggagggaaaggaa

SEQ ID NO: 14838 - RNA, 21 nt, Artificial Sequence
  Synthetic
cccuuuggggagggaaaggaa

SEQ ID NO: 14839 - RNA, 22 nt, Artificial Sequence
  Synthetic
ccccuuuggggagggaaaggaa

SEQ ID NO: 14840 - RNA, 23 nt, Artificial Sequence
  Synthetic
uccccuuuggggagggaaaggaa

SEQ ID NO: 14841 - RNA, 24 nt, Artificial Sequence
  Synthetic
cuccccuuuggggagggaaaggaa

SEQ ID NO: 14842 - RNA, 18 nt, Artificial Sequence
  Synthetic
uccccuuuggggagggaa

SEQ ID NO: 14843 - RNA, 19 nt, Artificial Sequence
  Synthetic
cuccccuuuggggagggaa

SEQ ID NO: 14844 - RNA, 21 nt, Artificial Sequence
  Synthetic
ggcuccccuuuggggagggaa

SEQ ID NO: 14845 - RNA, 22 nt, Artificial Sequence
  Synthetic
uggcuccccuuuggggagggaa

SEQ ID NO: 14846 - RNA, 23 nt, Artificial Sequence
  Synthetic
guggcuccccuuuggggagggaa

SEQ ID NO: 14847 - RNA, 24 nt, Artificial Sequence
  Synthetic
gguggcuccccuuuggggagggaa

SEQ ID NO: 14848 - RNA, 18 nt, Artificial Sequence
  Synthetic
ggaaaggaaggggacuaa

SEQ ID NO: 14849 - RNA, 19 nt, Artificial Sequence
  Synthetic
gggaaaggaaggggacuaa

SEQ ID NO: 14850 - RNA, 21 nt, Artificial Sequence
  Synthetic
gagggaaaggaaggggacuaa

SEQ ID NO: 14851 - RNA, 22 nt, Artificial Sequence
  Synthetic
ggagggaaaggaaggggacuaa

SEQ ID NO: 14852 - RNA, 23 nt, Artificial Sequence
  Synthetic
gggagggaaaggaaggggacuaa

SEQ ID NO: 14853 - RNA, 24 nt, Artificial Sequence
  Synthetic
ggggagggaaaggaaggggacuaa

SEQ ID NO: 14854 - RNA, 18 nt, Artificial Sequence
  Synthetic
agggugcugaggugcuca

SEQ ID NO: 14855 - RNA, 19 nt, Artificial Sequence
  Synthetic
cagggugcugaggugcuca

SEQ ID NO: 14856 - RNA, 20 nt, Artificial Sequence
  Synthetic
ccagggugcugaggugcuca

SEQ ID NO: 14857 - RNA, 21 nt, Artificial Sequence
  Synthetic
uccagggugcugaggugcuca

SEQ ID NO: 14858 - RNA, 22 nt, Artificial Sequence
  Synthetic
guccagggugcugaggugcuca

SEQ ID NO: 14859 - RNA, 23 nt, Artificial Sequence
  Synthetic
gguccagggugcugaggugcuca

SEQ ID NO: 14860 - RNA, 24 nt, Artificial Sequence
  Synthetic
ugguccagggugcugaggugcuca

SEQ ID NO: 14861 - RNA, 18 nt, Artificial Sequence
  Synthetic
cuuuggggagggaaagga

SEQ ID NO: 14862 - RNA, 19 nt, Artificial Sequence
  Synthetic
ccuuuggggagggaaagga

SEQ ID NO: 14863 - RNA, 21 nt, Artificial Sequence
  Synthetic
ccccuuuggggagggaaagga

SEQ ID NO: 14864 - RNA, 22 nt, Artificial Sequence
  Synthetic
uccccuuuggggagggaaagga

SEQ ID NO: 14865 - RNA, 23 nt, Artificial Sequence
  Synthetic
cuccccuuuggggagggaaagga

SEQ ID NO: 14866 - RNA, 24 nt, Artificial Sequence
  Synthetic
gcuccccuuuggggagggaaagga

SEQ ID NO: 14867 - RNA, 18 nt, Artificial Sequence
  Synthetic
cuccccuuuggggaggga

SEQ ID NO: 14868 - RNA, 19 nt, Artificial Sequence
  Synthetic
gcuccccuuuggggaggga

SEQ ID NO: 14869 - RNA, 20 nt, Artificial Sequence
  Synthetic
ggcuccccuuuggggaggga

SEQ ID NO: 14870 - RNA, 21 nt, Artificial Sequence
  Synthetic
uggcuccccuuuggggaggga

SEQ ID NO: 14871 - RNA, 22 nt, Artificial Sequence
  Synthetic
guggcuccccuuuggggaggga

SEQ ID NO: 14872 - RNA, 23 nt, Artificial Sequence
  Synthetic
gguggcuccccuuuggggaggga

SEQ ID NO: 14873 - RNA, 24 nt, Artificial Sequence
  Synthetic
ugguggcuccccuuuggggaggga

SEQ ID NO: 14874 - RNA, 18 nt, Artificial Sequence
  Synthetic
guggcuccccuuugggga

SEQ ID NO: 14875 - RNA, 19 nt, Artificial Sequence
  Synthetic
gguggcuccccuuugggga

SEQ ID NO: 14876 - RNA, 21 nt, Artificial Sequence
  Synthetic
augguggcuccccuuugggga

SEQ ID NO: 14877 - RNA, 22 nt, Artificial Sequence
  Synthetic
uaugguggcuccccuuugggga

SEQ ID NO: 14878 - RNA, 23 nt, Artificial Sequence
  Synthetic
uuaugguggcuccccuuugggga

SEQ ID NO: 14879 - RNA, 24 nt, Artificial Sequence
  Synthetic
auuaugguggcuccccuuugggga

SEQ ID NO: 14880 - RNA, 18 nt, Artificial Sequence
  Synthetic
gggaaaggaaggggacua

SEQ ID NO: 14881 - RNA, 19 nt, Artificial Sequence
  Synthetic
agggaaaggaaggggacua

SEQ ID NO: 14882 - RNA, 21 nt, Artificial Sequence
  Synthetic
ggagggaaaggaaggggacua

SEQ ID NO: 14883 - RNA, 22 nt, Artificial Sequence
  Synthetic
gggagggaaaggaaggggacua

SEQ ID NO: 14884 - RNA, 23 nt, Artificial Sequence
  Synthetic
ggggagggaaaggaaggggacua

SEQ ID NO: 14885 - RNA, 24 nt, Artificial Sequence
  Synthetic
uggggagggaaaggaaggggacua

SEQ ID NO: 14886 - RNA, 18 nt, Artificial Sequence
  Synthetic
gcaggcagagccucagac

SEQ ID NO: 14887 - RNA, 19 nt, Artificial Sequence
  Synthetic
ggcaggcagagccucagac

SEQ ID NO: 14888 - RNA, 20 nt, Artificial Sequence
  Synthetic
gggcaggcagagccucagac

SEQ ID NO: 14889 - RNA, 21 nt, Artificial Sequence
  Synthetic
ugggcaggcagagccucagac

SEQ ID NO: 14890 - RNA, 22 nt, Artificial Sequence
  Synthetic
cugggcaggcagagccucagac

SEQ ID NO: 14891 - RNA, 23 nt, Artificial Sequence
  Synthetic
acugggcaggcagagccucagac

SEQ ID NO: 14892 - RNA, 24 nt, Artificial Sequence
  Synthetic
cacugggcaggcagagccucagac

SEQ ID NO: 14893 - RNA, 18 nt, Artificial Sequence
  Synthetic
ugcugcuguacuccagcc

SEQ ID NO: 14894 - RNA, 19 nt, Artificial Sequence
  Synthetic
augcugcuguacuccagcc

SEQ ID NO: 14895 - RNA, 20 nt, Artificial Sequence
  Synthetic
caugcugcuguacuccagcc

SEQ ID NO: 14896 - RNA, 21 nt, Artificial Sequence
  Synthetic
ucaugcugcuguacuccagcc

SEQ ID NO: 14897 - RNA, 22 nt, Artificial Sequence
  Synthetic
aucaugcugcuguacuccagcc

SEQ ID NO: 14898 - RNA, 23 nt, Artificial Sequence
  Synthetic
gaucaugcugcuguacuccagcc

SEQ ID NO: 14899 - RNA, 24 nt, Artificial Sequence
  Synthetic
ugaucaugcugcuguacuccagcc

SEQ ID NO: 14900 - RNA, 18 nt, Artificial Sequence
  Synthetic
uucccuggugccugcgcc

SEQ ID NO: 14901 - RNA, 19 nt, Artificial Sequence
  Synthetic
cuucccuggugccugcgcc

SEQ ID NO: 14902 - RNA, 21 nt, Artificial Sequence
  Synthetic
cccuucccuggugccugcgcc

SEQ ID NO: 14903 - RNA, 22 nt, Artificial Sequence
  Synthetic
ccccuucccuggugccugcgcc

SEQ ID NO: 14904 - RNA, 23 nt, Artificial Sequence
  Synthetic
gccccuucccuggugccugcgcc

SEQ ID NO: 14905 - RNA, 24 nt, Artificial Sequence
  Synthetic
ugccccuucccuggugccugcgcc

SEQ ID NO: 14906 - RNA, 18 nt, Artificial Sequence
  Synthetic
cuucccuggugccugcgc

SEQ ID NO: 14907 - RNA, 19 nt, Artificial Sequence
  Synthetic
ccuucccuggugccugcgc

SEQ ID NO: 14908 - RNA, 20 nt, Artificial Sequence
  Synthetic
cccuucccuggugccugcgc

SEQ ID NO: 14909 - RNA, 21 nt, Artificial Sequence
  Synthetic
ccccuucccuggugccugcgc

SEQ ID NO: 14910 - RNA, 22 nt, Artificial Sequence
  Synthetic
gccccuucccuggugccugcgc

SEQ ID NO: 14911 - RNA, 23 nt, Artificial Sequence
  Synthetic
ugccccuucccuggugccugcgc

SEQ ID NO: 14912 - RNA, 24 nt, Artificial Sequence
  Synthetic
cugccccuucccuggugccugcgc

SEQ ID NO: 14913 - RNA, 18 nt, Artificial Sequence
  Synthetic
ccuuuggggagggaaagg

SEQ ID NO: 14914 - RNA, 19 nt, Artificial Sequence
  Synthetic
cccuuuggggagggaaagg

SEQ ID NO: 14915 - RNA, 20 nt, Artificial Sequence
  Synthetic
ccccuuuggggagggaaagg

SEQ ID NO: 14916 - RNA, 21 nt, Artificial Sequence
  Synthetic
uccccuuuggggagggaaagg

SEQ ID NO: 14917 - RNA, 22 nt, Artificial Sequence
  Synthetic
cuccccuuuggggagggaaagg

SEQ ID NO: 14918 - RNA, 23 nt, Artificial Sequence
  Synthetic
gcuccccuuuggggagggaaagg

SEQ ID NO: 14919 - RNA, 24 nt, Artificial Sequence
  Synthetic
ggcuccccuuuggggagggaaagg

SEQ ID NO: 14920 - RNA, 18 nt, Artificial Sequence
  Synthetic
ugacaccccugucccagg

SEQ ID NO: 14921 - RNA, 19 nt, Artificial Sequence
  Synthetic
cugacaccccugucccagg

SEQ ID NO: 14922 - RNA, 20 nt, Artificial Sequence
  Synthetic
acugacaccccugucccagg

SEQ ID NO: 14923 - RNA, 21 nt, Artificial Sequence
  Synthetic
aacugacaccccugucccagg

SEQ ID NO: 14924 - RNA, 22 nt, Artificial Sequence
  Synthetic
gaacugacaccccugucccagg

SEQ ID NO: 14925 - RNA, 23 nt, Artificial Sequence
  Synthetic
ggaacugacaccccugucccagg

SEQ ID NO: 14926 - RNA, 24 nt, Artificial Sequence
  Synthetic
gggaacugacaccccugucccagg

SEQ ID NO: 14927 - RNA, 18 nt, Artificial Sequence
  Synthetic
aggugcucacugggcagg

SEQ ID NO: 14928 - RNA, 19 nt, Artificial Sequence
  Synthetic
gaggugcucacugggcagg

SEQ ID NO: 14929 - RNA, 20 nt, Artificial Sequence
  Synthetic
ugaggugcucacugggcagg

SEQ ID NO: 14930 - RNA, 21 nt, Artificial Sequence
  Synthetic
cugaggugcucacugggcagg

SEQ ID NO: 14931 - RNA, 22 nt, Artificial Sequence
  Synthetic
gcugaggugcucacugggcagg

SEQ ID NO: 14932 - RNA, 23 nt, Artificial Sequence
  Synthetic
ugcugaggugcucacugggcagg

SEQ ID NO: 14933 - RNA, 24 nt, Artificial Sequence
  Synthetic
gugcugaggugcucacugggcagg

SEQ ID NO: 14934 - RNA, 18 nt, Artificial Sequence
  Synthetic
agagccucagaccugagg

SEQ ID NO: 14935 - RNA, 19 nt, Artificial Sequence
  Synthetic
cagagccucagaccugagg

SEQ ID NO: 14936 - RNA, 20 nt, Artificial Sequence
  Synthetic
gcagagccucagaccugagg

SEQ ID NO: 14937 - RNA, 21 nt, Artificial Sequence
  Synthetic
ggcagagccucagaccugagg

SEQ ID NO: 14938 - RNA, 22 nt, Artificial Sequence
  Synthetic
aggcagagccucagaccugagg

SEQ ID NO: 14939 - RNA, 23 nt, Artificial Sequence
  Synthetic
caggcagagccucagaccugagg

SEQ ID NO: 14940 - RNA, 24 nt, Artificial Sequence
  Synthetic
gcaggcagagccucagaccugagg

SEQ ID NO: 14941 - RNA, 18 nt, Artificial Sequence
  Synthetic
ugccacucccauacccgg

SEQ ID NO: 14942 - RNA, 19 nt, Artificial Sequence
  Synthetic
uugccacucccauacccgg

SEQ ID NO: 14943 - RNA, 20 nt, Artificial Sequence
  Synthetic
auugccacucccauacccgg

SEQ ID NO: 14944 - RNA, 21 nt, Artificial Sequence
  Synthetic
cauugccacucccauacccgg

SEQ ID NO: 14945 - RNA, 22 nt, Artificial Sequence
  Synthetic
gcauugccacucccauacccgg

SEQ ID NO: 14946 - RNA, 23 nt, Artificial Sequence
  Synthetic
cgcauugccacucccauacccgg

SEQ ID NO: 14947 - RNA, 24 nt, Artificial Sequence
  Synthetic
ucgcauugccacucccauacccgg

SEQ ID NO: 14948 - RNA, 18 nt, Artificial Sequence
  Synthetic
gagccucagaccugaggg

SEQ ID NO: 14949 - RNA, 19 nt, Artificial Sequence
  Synthetic
agagccucagaccugaggg

SEQ ID NO: 14950 - RNA, 21 nt, Artificial Sequence
  Synthetic
gcagagccucagaccugaggg

SEQ ID NO: 14951 - RNA, 22 nt, Artificial Sequence
  Synthetic
ggcagagccucagaccugaggg

SEQ ID NO: 14952 - RNA, 23 nt, Artificial Sequence
  Synthetic
aggcagagccucagaccugaggg

SEQ ID NO: 14953 - RNA, 24 nt, Artificial Sequence
  Synthetic
caggcagagccucagaccugaggg

SEQ ID NO: 14954 - RNA, 18 nt, Artificial Sequence
  Synthetic
gguggcuccccuuugggg

SEQ ID NO: 14955 - RNA, 19 nt, Artificial Sequence
  Synthetic
ugguggcuccccuuugggg

SEQ ID NO: 14956 - RNA, 21 nt, Artificial Sequence
  Synthetic
uaugguggcuccccuuugggg

SEQ ID NO: 14957 - RNA, 22 nt, Artificial Sequence
  Synthetic
uuaugguggcuccccuuugggg

SEQ ID NO: 14958 - RNA, 23 nt, Artificial Sequence
  Synthetic
auuaugguggcuccccuuugggg

SEQ ID NO: 14959 - RNA, 24 nt, Artificial Sequence
  Synthetic
aauuaugguggcuccccuuugggg

SEQ ID NO: 14960 - RNA, 18 nt, Artificial Sequence
  Synthetic
ugguggcuccccuuuggg

SEQ ID NO: 14961 - RNA, 19 nt, Artificial Sequence
  Synthetic
augguggcuccccuuuggg

SEQ ID NO: 14962 - RNA, 20 nt, Artificial Sequence
  Synthetic
uaugguggcuccccuuuggg

SEQ ID NO: 14963 - RNA, 21 nt, Artificial Sequence
  Synthetic
uuaugguggcuccccuuuggg

SEQ ID NO: 14964 - RNA, 22 nt, Artificial Sequence
  Synthetic
auuaugguggcuccccuuuggg

SEQ ID NO: 14965 - RNA, 23 nt, Artificial Sequence
  Synthetic
aauuaugguggcuccccuuuggg

SEQ ID NO: 14966 - RNA, 24 nt, Artificial Sequence
  Synthetic
aaauuaugguggcuccccuuuggg

SEQ ID NO: 14967 - RNA, 18 nt, Artificial Sequence
  Synthetic
gaagggugguccagggug

SEQ ID NO: 14968 - RNA, 19 nt, Artificial Sequence
  Synthetic
ggaagggugguccagggug

SEQ ID NO: 14969 - RNA, 20 nt, Artificial Sequence
  Synthetic
uggaagggugguccagggug

SEQ ID NO: 14970 - RNA, 21 nt, Artificial Sequence
  Synthetic
cuggaagggugguccagggug

SEQ ID NO: 14971 - RNA, 22 nt, Artificial Sequence
  Synthetic
ccuggaagggugguccagggug

SEQ ID NO: 14972 - RNA, 23 nt, Artificial Sequence
  Synthetic
gccuggaagggugguccagggug

SEQ ID NO: 14973 - RNA, 24 nt, Artificial Sequence
  Synthetic
cgccuggaagggugguccagggug

SEQ ID NO: 14974 - RNA, 18 nt, Artificial Sequence
  Synthetic
cuauauacuucuguauug

SEQ ID NO: 14975 - RNA, 19 nt, Artificial Sequence
  Synthetic
ucuauauacuucuguauug

SEQ ID NO: 14976 - RNA, 20 nt, Artificial Sequence
  Synthetic
cucuauauacuucuguauug

SEQ ID NO: 14977 - RNA, 21 nt, Artificial Sequence
  Synthetic
gcucuauauacuucuguauug

SEQ ID NO: 14978 - RNA, 22 nt, Artificial Sequence
  Synthetic
agcucuauauacuucuguauug

SEQ ID NO: 14979 - RNA, 23 nt, Artificial Sequence
  Synthetic
aagcucuauauacuucuguauug

SEQ ID NO: 14980 - RNA, 24 nt, Artificial Sequence
  Synthetic
gaagcucuauauacuucuguauug

SEQ ID NO: 14981 - RNA, 18 nt, Artificial Sequence
  Synthetic
aagcaaaaauggaaguug

SEQ ID NO: 14982 - RNA, 19 nt, Artificial Sequence
  Synthetic
aaagcaaaaauggaaguug

SEQ ID NO: 14983 - RNA, 20 nt, Artificial Sequence
  Synthetic
aaaagcaaaaauggaaguug

SEQ ID NO: 14984 - RNA, 21 nt, Artificial Sequence
  Synthetic
uaaaagcaaaaauggaaguug

SEQ ID NO: 14985 - RNA, 22 nt, Artificial Sequence
  Synthetic
auaaaagcaaaaauggaaguug

SEQ ID NO: 14986 - RNA, 23 nt, Artificial Sequence
  Synthetic
aauaaaagcaaaaauggaaguug

SEQ ID NO: 14987 - RNA, 24 nt, Artificial Sequence
  Synthetic
aaauaaaagcaaaaauggaaguug

SEQ ID NO: 14988 - RNA, 18 nt, Artificial Sequence
  Synthetic
uaugguggcuccccuuug

SEQ ID NO: 14989 - RNA, 19 nt, Artificial Sequence
  Synthetic
uuaugguggcuccccuuug

SEQ ID NO: 14990 - RNA, 21 nt, Artificial Sequence
  Synthetic
aauuaugguggcuccccuuug

SEQ ID NO: 14991 - RNA, 22 nt, Artificial Sequence
  Synthetic
aaauuaugguggcuccccuuug

SEQ ID NO: 14992 - RNA, 23 nt, Artificial Sequence
  Synthetic
caaauuaugguggcuccccuuug

SEQ ID NO: 14993 - RNA, 24 nt, Artificial Sequence
  Synthetic
acaaauuaugguggcuccccuuug

SEQ ID NO: 14994 - RNA, 18 nt, Artificial Sequence
  Synthetic
ccugucucuaagauaaau

SEQ ID NO: 14995 - RNA, 19 nt, Artificial Sequence
  Synthetic
uccugucucuaagauaaau

SEQ ID NO: 14996 - RNA, 20 nt, Artificial Sequence
  Synthetic
auccugucucuaagauaaau

SEQ ID NO: 14997 - RNA, 21 nt, Artificial Sequence
  Synthetic
gauccugucucuaagauaaau

SEQ ID NO: 14998 - RNA, 22 nt, Artificial Sequence
  Synthetic
ugauccugucucuaagauaaau

SEQ ID NO: 14999 - RNA, 23 nt, Artificial Sequence
  Synthetic
augauccugucucuaagauaaau

SEQ ID NO: 15000 - RNA, 24 nt, Artificial Sequence
  Synthetic
caugauccugucucuaagauaaau

SEQ ID NO: 15001 - RNA, 18 nt, Artificial Sequence
  Synthetic
agggaaaggaaggggacu

SEQ ID NO: 15002 - RNA, 19 nt, Artificial Sequence
  Synthetic
gagggaaaggaaggggacu

SEQ ID NO: 15003 - RNA, 20 nt, Artificial Sequence
  Synthetic
ggagggaaaggaaggggacu

SEQ ID NO: 15004 - RNA, 21 nt, Artificial Sequence
  Synthetic
gggagggaaaggaaggggacu

SEQ ID NO: 15005 - RNA, 22 nt, Artificial Sequence
  Synthetic
ggggagggaaaggaaggggacu

SEQ ID NO: 15006 - RNA, 23 nt, Artificial Sequence
  Synthetic
uggggagggaaaggaaggggacu

SEQ ID NO: 15007 - RNA, 24 nt, Artificial Sequence
  Synthetic
uuggggagggaaaggaaggggacu

SEQ ID NO: 15008 - RNA, 18 nt, Artificial Sequence
  Synthetic
aauuaugguggcuccccu

SEQ ID NO: 15009 - RNA, 19 nt, Artificial Sequence
  Synthetic
aaauuaugguggcuccccu

SEQ ID NO: 15010 - RNA, 20 nt, Artificial Sequence
  Synthetic
caaauuaugguggcuccccu

SEQ ID NO: 15011 - RNA, 21 nt, Artificial Sequence
  Synthetic
acaaauuaugguggcuccccu

SEQ ID NO: 15012 - RNA, 22 nt, Artificial Sequence
  Synthetic
uacaaauuaugguggcuccccu

SEQ ID NO: 15013 - RNA, 23 nt, Artificial Sequence
  Synthetic
auacaaauuaugguggcuccccu

SEQ ID NO: 15014 - RNA, 24 nt, Artificial Sequence
  Synthetic
uauacaaauuaugguggcuccccu

SEQ ID NO: 15015 - RNA, 18 nt, Artificial Sequence
  Synthetic
agccucagaccugagggu

SEQ ID NO: 15016 - RNA, 19 nt, Artificial Sequence
  Synthetic
gagccucagaccugagggu

SEQ ID NO: 15017 - RNA, 21 nt, Artificial Sequence
  Synthetic
cagagccucagaccugagggu

SEQ ID NO: 15018 - RNA, 22 nt, Artificial Sequence
  Synthetic
gcagagccucagaccugagggu

SEQ ID NO: 15019 - RNA, 23 nt, Artificial Sequence
  Synthetic
ggcagagccucagaccugagggu

SEQ ID NO: 15020 - RNA, 24 nt, Artificial Sequence
  Synthetic
aggcagagccucagaccugagggu

SEQ ID NO: 15021 - RNA, 18 nt, Artificial Sequence
  Synthetic
auuaugguggcuccccuu

SEQ ID NO: 15022 - RNA, 19 nt, Artificial Sequence
  Synthetic
aauuaugguggcuccccuu

SEQ ID NO: 15023 - RNA, 21 nt, Artificial Sequence
  Synthetic
caaauuaugguggcuccccuu

SEQ ID NO: 15024 - RNA, 22 nt, Artificial Sequence
  Synthetic
acaaauuaugguggcuccccuu

SEQ ID NO: 15025 - RNA, 23 nt, Artificial Sequence
  Synthetic
uacaaauuaugguggcuccccuu

SEQ ID NO: 15026 - RNA, 24 nt, Artificial Sequence
  Synthetic
auacaaauuaugguggcuccccuu

SEQ ID NO: 15027 - RNA, 18 nt, Artificial Sequence
  Synthetic
uuaugguggcuccccuuu

SEQ ID NO: 15028 - RNA, 19 nt, Artificial Sequence
  Synthetic
auuaugguggcuccccuuu

SEQ ID NO: 15029 - RNA, 21 nt, Artificial Sequence
  Synthetic
aaauuaugguggcuccccuuu

SEQ ID NO: 15030 - RNA, 22 nt, Artificial Sequence
  Synthetic
caaauuaugguggcuccccuuu

SEQ ID NO: 15031 - RNA, 23 nt, Artificial Sequence
  Synthetic
acaaauuaugguggcuccccuuu

SEQ ID NO: 15032 - RNA, 24 nt, Artificial Sequence
  Synthetic
uacaaauuaugguggcuccccuuu

SEQ ID NO: 15033 - RNA, 17 nt, Artificial Sequence
  Synthetic
gugaaagccggugucaa

SEQ ID NO: 15034 - RNA, 17 nt, Artificial Sequence
  Synthetic
guuuucuaaccucagaa

SEQ ID NO: 15035 - RNA, 17 nt, Artificial Sequence
  Synthetic
gcugcauuaaguuugga

SEQ ID NO: 15036 - RNA, 17 nt, Artificial Sequence
  Synthetic
gaugcuaaugagauucc

SEQ ID NO: 15037 - RNA, 17 nt, Artificial Sequence
  Synthetic
ggccaaaagugccggag

SEQ ID NO: 15038 - RNA, 17 nt, Artificial Sequence
  Synthetic
gaugacaccuucucugg

SEQ ID NO: 15039 - RNA, 17 nt, Artificial Sequence
  Synthetic
gcugccuuaagcuagug

SEQ ID NO: 15040 - RNA, 17 nt, Artificial Sequence
  Synthetic
gcuaaacuccuugcuug

SEQ ID NO: 15041 - RNA, 17 nt, Artificial Sequence
  Synthetic
ggagugagggaggccuu

SEQ ID NO: 15042 - RNA, 20 nt, Artificial Sequence
  Synthetic
gagcaaggggggagucccaa

SEQ ID NO: 15043 - RNA, 20 nt, Artificial Sequence
  Synthetic
gguuuggaauccugguugac

SEQ ID NO: 15044 - RNA, 20 nt, Artificial Sequence
  Synthetic
gcucaggguccaaccugguc

SEQ ID NO: 15045 - RNA, 20 nt, Artificial Sequence
  Synthetic
ggcccugaccucgagcugug

SEQ ID NO: 15046 - RNA, 20 nt, Artificial Sequence
  Synthetic
gggggaggagagguuuggcu

SEQ ID NO: 15047 - RNA, 20 nt, Artificial Sequence
  Synthetic
gugggagugagggaggccuu

SEQ ID NO: 15048 - RNA, 20 nt, Artificial Sequence
  Synthetic
gguuucuauuuguacacuuu

SEQ ID NO: 15049 - RNA, 17 nt, Artificial Sequence
  Synthetic
caaggggggagucccaa

SEQ ID NO: 15050 - RNA, 17 nt, Artificial Sequence
  Synthetic
uccccuuggaagggaca

SEQ ID NO: 15051 - RNA, 17 nt, Artificial Sequence
  Synthetic
cuuuaauugagaugcua

SEQ ID NO: 15052 - RNA, 17 nt, Artificial Sequence
  Synthetic
uuggaauccugguugac

SEQ ID NO: 15053 - RNA, 17 nt, Artificial Sequence
  Synthetic
augccugaaauccaacc

SEQ ID NO: 15054 - RNA, 17 nt, Artificial Sequence
  Synthetic
cacucccacacagagcc

SEQ ID NO: 15055 - RNA, 17 nt, Artificial Sequence
  Synthetic
uagggccccgccuagcc

SEQ ID NO: 15056 - RNA, 17 nt, Artificial Sequence
  Synthetic
aggaggucugggcugcc

SEQ ID NO: 15057 - RNA, 17 nt, Artificial Sequence
  Synthetic
uggucccuccucuuucc

SEQ ID NO: 15058 - RNA, 17 nt, Artificial Sequence
  Synthetic
cacgcggcagggaaggc

SEQ ID NO: 15059 - RNA, 17 nt, Artificial Sequence
  Synthetic
cccuagaacggccucuc

SEQ ID NO: 15060 - RNA, 17 nt, Artificial Sequence
  Synthetic
caggguccaaccugguc

SEQ ID NO: 15061 - RNA, 17 nt, Artificial Sequence
  Synthetic
agugcaggaaugugguc

SEQ ID NO: 15062 - RNA, 17 nt, Artificial Sequence
  Synthetic
ccuccagcccuuuuugg

SEQ ID NO: 15063 - RNA, 17 nt, Artificial Sequence
  Synthetic
ccugaccucgagcugug

SEQ ID NO: 15064 - RNA, 17 nt, Artificial Sequence
  Synthetic
cuaacaaaagugcagau

SEQ ID NO: 15065 - RNA, 17 nt, Artificial Sequence
  Synthetic
ucuuugccugcuaaacu

SEQ ID NO: 15066 - RNA, 17 nt, Artificial Sequence
  Synthetic
cucuggggcuaucuacu

SEQ ID NO: 15067 - RNA, 17 nt, Artificial Sequence
  Synthetic
uucuauuuguacacuuu

SEQ ID NO: 15068 - RNA, 20 nt, Artificial Sequence
  Synthetic
aaagugaaagccggugucaa

SEQ ID NO: 15069 - RNA, 20 nt, Artificial Sequence
  Synthetic
uuuguuuucuaaccucagaa

SEQ ID NO: 15070 - RNA, 20 nt, Artificial Sequence
  Synthetic
accuccccuuggaagggaca

SEQ ID NO: 15071 - RNA, 20 nt, Artificial Sequence
  Synthetic
cucaugccugaaauccaacc

SEQ ID NO: 15072 - RNA, 20 nt, Artificial Sequence
  Synthetic
ccucacucccacacagagcc

SEQ ID NO: 15073 - RNA, 20 nt, Artificial Sequence
  Synthetic
uccuagggccccgccuagcc

SEQ ID NO: 15074 - RNA, 20 nt, Artificial Sequence
  Synthetic
uccaggaggucugggcugcc

SEQ ID NO: 15075 - RNA, 20 nt, Artificial Sequence
  Synthetic
ugagaugcuaaugagauucc

SEQ ID NO: 15076 - RNA, 20 nt, Artificial Sequence
  Synthetic
uccuggucccuccucuuucc

SEQ ID NO: 15077 - RNA, 20 nt, Artificial Sequence
  Synthetic
cugcacgcggcagggaaggc

SEQ ID NO: 15078 - RNA, 20 nt, Artificial Sequence
  Synthetic
cuucccuagaacggccucuc

SEQ ID NO: 15079 - RNA, 20 nt, Artificial Sequence
  Synthetic
cagagugcaggaaugugguc

SEQ ID NO: 15080 - RNA, 20 nt, Artificial Sequence
  Synthetic
ucuccuccagcccuuuuugg

SEQ ID NO: 15081 - RNA, 20 nt, Artificial Sequence
  Synthetic
caugcugccuuaagcuagug

SEQ ID NO: 15082 - RNA, 20 nt, Artificial Sequence
  Synthetic
ccugcuaaacuccuugcuug

SEQ ID NO: 15083 - RNA, 20 nt, Artificial Sequence
  Synthetic
cuucuaacaaaagugcagau

SEQ ID NO: 15084 - RNA, 20 nt, Artificial Sequence
  Synthetic
ucuucuuugccugcuaaacu

SEQ ID NO: 15085 - RNA, 20 nt, Artificial Sequence
  Synthetic
cuccucuggggcuaucuacu

SEQ ID NO: 15086 - RNA, 20 nt, Artificial Sequence
  Synthetic
cucaggcugggccuuugucu

SEQ ID NO: 15087 - RNA, 20 nt, Artificial Sequence
  Synthetic
auccucccugcaccuucagu

SEQ ID NO: 15088 - RNA, 17 nt, Artificial Sequence
  Synthetic
gggggagaggaagagag

SEQ ID NO: 15089 - RNA, 17 nt, Artificial Sequence
  Synthetic
ggaggagagguuuggcu

SEQ ID NO: 15090 - RNA, 17 nt, Artificial Sequence
  Synthetic
aggcugggccuuugucu

SEQ ID NO: 15091 - RNA, 17 nt, Artificial Sequence
  Synthetic
cucccugcaccuucagu

SEQ ID NO: 15092 - RNA, 20 nt, Artificial Sequence
  Synthetic
agggggggagaggaagagag

SEQ ID NO: 15093 - RNA, 20 nt, Artificial Sequence
  Synthetic
agagaugacaccuucucugg

SEQ ID NO: 15094 - RNA, 17 nt, Artificial Sequence
  Synthetic
accuggagcgggcuaga

SEQ ID NO: 15095 - RNA, 17 nt, Artificial Sequence
  Synthetic
agcaauacagaaguaua

SEQ ID NO: 15096 - RNA, 17 nt, Artificial Sequence
  Synthetic
guuucuacaacuuccau

SEQ ID NO: 15097 - RNA, 17 nt, Artificial Sequence
  Synthetic
cugaccaaaguccaggu

SEQ ID NO: 15098 - RNA, 20 nt, Artificial Sequence
  Synthetic
uagaccuggagcgggcuaga

SEQ ID NO: 15099 - RNA, 20 nt, Artificial Sequence
  Synthetic
uauguuucuacaacuuccau

SEQ ID NO: 15100 - RNA, 20 nt, Artificial Sequence
  Synthetic
cuucugaccaaaguccaggu

SEQ ID NO: 15101 - RNA, 17 nt, Artificial Sequence
  Synthetic
guacaaaguaccaaaaa

SEQ ID NO: 15102 - RNA, 17 nt, Artificial Sequence
  Synthetic
gccugaugccagauaaa

SEQ ID NO: 15103 - RNA, 17 nt, Artificial Sequence
  Synthetic
gguaaacaauuagacaa

SEQ ID NO: 15104 - RNA, 17 nt, Artificial Sequence
  Synthetic
gacuaugaguggcccaa

SEQ ID NO: 15105 - RNA, 17 nt, Artificial Sequence
  Synthetic
gccuugcucucuaggaa

SEQ ID NO: 15106 - RNA, 17 nt, Artificial Sequence
  Synthetic
gcucuaaaucacucuaa

SEQ ID NO: 15107 - RNA, 17 nt, Artificial Sequence
  Synthetic
gggaagucuuaagguaa

SEQ ID NO: 15108 - RNA, 17 nt, Artificial Sequence
  Synthetic
guuaccauaaguaaaca

SEQ ID NO: 15109 - RNA, 17 nt, Artificial Sequence
  Synthetic
gcaaagaguucuaacca

SEQ ID NO: 15110 - RNA, 17 nt, Artificial Sequence
  Synthetic
ggaacucaaugggacca

SEQ ID NO: 15111 - RNA, 17 nt, Artificial Sequence
  Synthetic
gcucaauuuugugacca

SEQ ID NO: 15112 - RNA, 17 nt, Artificial Sequence
  Synthetic
gccagggucacuuccca

SEQ ID NO: 15113 - RNA, 17 nt, Artificial Sequence
  Synthetic
guagaggauucaaucca

SEQ ID NO: 15114 - RNA, 17 nt, Artificial Sequence
  Synthetic
gaccucagcuggaauca

SEQ ID NO: 15115 - RNA, 17 nt, Artificial Sequence
  Synthetic
guaguuaccugaggaga

SEQ ID NO: 15116 - RNA, 17 nt, Artificial Sequence
  Synthetic
ggagaagcaugugggga

SEQ ID NO: 15117 - RNA, 17 nt, Artificial Sequence
  Synthetic
gucccauugaguuccua

SEQ ID NO: 15118 - RNA, 17 nt, Artificial Sequence
  Synthetic
gcaaaugccaugaggua

SEQ ID NO: 15119 - RNA, 17 nt, Artificial Sequence
  Synthetic
gaggucucuagugaccc

SEQ ID NO: 15120 - RNA, 17 nt, Artificial Sequence
  Synthetic
gcaauacagaccucagc

SEQ ID NO: 15121 - RNA, 17 nt, Artificial Sequence
  Synthetic
gaaaccuguagcauugc

SEQ ID NO: 15122 - RNA, 17 nt, Artificial Sequence
  Synthetic
gauucauguucucuauc

SEQ ID NO: 15123 - RNA, 17 nt, Artificial Sequence
  Synthetic
gaauuugcagaauuauc

SEQ ID NO: 15124 - RNA, 17 nt, Artificial Sequence
  Synthetic
gaccuugccuucuccuc

SEQ ID NO: 15125 - RNA, 17 nt, Artificial Sequence
  Synthetic
guuccaagauuguaguc

SEQ ID NO: 15126 - RNA, 17 nt, Artificial Sequence
  Synthetic
gguucaaugugaaaaag

SEQ ID NO: 15127 - RNA, 17 nt, Artificial Sequence
  Synthetic
guaauaggccggggcag

SEQ ID NO: 15128 - RNA, 17 nt, Artificial Sequence
  Synthetic
gcuuuacguuucaucag

SEQ ID NO: 15129 - RNA, 17 nt, Artificial Sequence
  Synthetic
gagagauucuuuauggg

SEQ ID NO: 15130 - RNA, 17 nt, Artificial Sequence
  Synthetic
gaucugggccugguaug

SEQ ID NO: 15131 - RNA, 17 nt, Artificial Sequence
  Synthetic
ggccuuaggaacucaau

SEQ ID NO: 15132 - RNA, 17 nt, Artificial Sequence
  Synthetic
gguaacuugacaguaau

SEQ ID NO: 15133 - RNA, 17 nt, Artificial Sequence
  Synthetic
gauccuaaccuuuugau

SEQ ID NO: 15134 - RNA, 17 nt, Artificial Sequence
  Synthetic
gugaaacuugaacaacu

SEQ ID NO: 15135 - RNA, 17 nt, Artificial Sequence
  Synthetic
gaacuaugugaagaccu

SEQ ID NO: 15136 - RNA, 17 nt, Artificial Sequence
  Synthetic
gguggcauuugaguccu

SEQ ID NO: 15137 - RNA, 17 nt, Artificial Sequence
  Synthetic
guauugccuugcucucu

SEQ ID NO: 15138 - RNA, 17 nt, Artificial Sequence
  Synthetic
gaaugauuaaucagagu

SEQ ID NO: 15139 - RNA, 17 nt, Artificial Sequence
  Synthetic
ggugaugugguucuagu

SEQ ID NO: 15140 - RNA, 17 nt, Artificial Sequence
  Synthetic
gguggagaacuggccuu

SEQ ID NO: 15141 - RNA, 17 nt, Artificial Sequence
  Synthetic
gagugacauaccauuuu

SEQ ID NO: 15142 - RNA, 20 nt, Artificial Sequence
  Synthetic
gccuucaaaaugccaaaaaa

SEQ ID NO: 15143 - RNA, 20 nt, Artificial Sequence
  Synthetic
gagguacaaaguaccaaaaa

SEQ ID NO: 15144 - RNA, 20 nt, Artificial Sequence
  Synthetic
guguacauaaaccaacaaaa

SEQ ID NO: 15145 - RNA, 20 nt, Artificial Sequence
  Synthetic
gguaauuaggcuuuauagaa

SEQ ID NO: 15146 - RNA, 20 nt, Artificial Sequence
  Synthetic
gcaauguaguuuuaggaaca

SEQ ID NO: 15147 - RNA, 20 nt, Artificial Sequence
  Synthetic
ggagcaaagaguucuaacca

SEQ ID NO: 15148 - RNA, 20 nt, Artificial Sequence
  Synthetic
gaagccagggucacuuccca

SEQ ID NO: 15149 - RNA, 20 nt, Artificial Sequence
  Synthetic
ggauuuuucacauuuagcca

SEQ ID NO: 15150 - RNA, 20 nt, Artificial Sequence
  Synthetic
gauucacacuucuaagauca

SEQ ID NO: 15151 - RNA, 20 nt, Artificial Sequence
  Synthetic
gcccucaagugguugccaga

SEQ ID NO: 15152 - RNA, 20 nt, Artificial Sequence
  Synthetic
gggguaguuaccugaggaga

SEQ ID NO: 15153 - RNA, 20 nt, Artificial Sequence
  Synthetic
gguggagaagcaugugggga

SEQ ID NO: 15154 - RNA, 20 nt, Artificial Sequence
  Synthetic
gaguaaccaaauguuaugga

SEQ ID NO: 15155 - RNA, 20 nt, Artificial Sequence
  Synthetic
gggaaugauuaaucagagua

SEQ ID NO: 15156 - RNA, 20 nt, Artificial Sequence
  Synthetic
guacucccugggaagucuua

SEQ ID NO: 15157 - RNA, 20 nt, Artificial Sequence
  Synthetic
ggaaacugagagauucuuua

SEQ ID NO: 15158 - RNA, 20 nt, Artificial Sequence
  Synthetic
gagucucgugccaacagcac

SEQ ID NO: 15159 - RNA, 20 nt, Artificial Sequence
  Synthetic
guaaauuggguuucugucac

SEQ ID NO: 15160 - RNA, 20 nt, Artificial Sequence
  Synthetic
gaaagugaaguagagagacc

SEQ ID NO: 15161 - RNA, 20 nt, Artificial Sequence
  Synthetic
gcacccuugggaagugaccc

SEQ ID NO: 15162 - RNA, 20 nt, Artificial Sequence
  Synthetic
gcuaacauucucugcucucc

SEQ ID NO: 15163 - RNA, 20 nt, Artificial Sequence
  Synthetic
guuaauguucuucaaccauc

SEQ ID NO: 15164 - RNA, 20 nt, Artificial Sequence
  Synthetic
gaccagcuuucuacauaaag

SEQ ID NO: 15165 - RNA, 20 nt, Artificial Sequence
  Synthetic
guguuguuauauuucauaag

SEQ ID NO: 15166 - RNA, 20 nt, Artificial Sequence
  Synthetic
ggaguaauaggccggggcag

SEQ ID NO: 15167 - RNA, 20 nt, Artificial Sequence
  Synthetic
gucacuucccaagggugcag

SEQ ID NO: 15168 - RNA, 20 nt, Artificial Sequence
  Synthetic
gauaaaagggugagugaagg

SEQ ID NO: 15169 - RNA, 20 nt, Artificial Sequence
  Synthetic
gaacuaugugaagaccuagg

SEQ ID NO: 15170 - RNA, 20 nt, Artificial Sequence
  Synthetic
guuuaccuaguucuuccuug

SEQ ID NO: 15171 - RNA, 20 nt, Artificial Sequence
  Synthetic
ggucggggaauuucuuuaau

SEQ ID NO: 15172 - RNA, 20 nt, Artificial Sequence
  Synthetic
gucacaaaauugagccagau

SEQ ID NO: 15173 - RNA, 20 nt, Artificial Sequence
  Synthetic
gaaacugagagauucuuuau

SEQ ID NO: 15174 - RNA, 20 nt, Artificial Sequence
  Synthetic
gagucauagugcuuaccccu

SEQ ID NO: 15175 - RNA, 20 nt, Artificial Sequence
  Synthetic
gcucucauuagcaagcuucu

SEQ ID NO: 15176 - RNA, 20 nt, Artificial Sequence
  Synthetic
guaggugaugugguucuagu

SEQ ID NO: 15177 - RNA, 20 nt, Artificial Sequence
  Synthetic
gaagagugacauaccauuuu

SEQ ID NO: 15178 - RNA, 17 nt, Artificial Sequence
  Synthetic
ccugaugccagauaaaa

SEQ ID NO: 15179 - RNA, 17 nt, Artificial Sequence
  Synthetic
auuuagccaaggacaaa

SEQ ID NO: 15180 - RNA, 17 nt, Artificial Sequence
  Synthetic
cauuuagccaaggacaa

SEQ ID NO: 15181 - RNA, 17 nt, Artificial Sequence
  Synthetic
ccagggucacuucccaa

SEQ ID NO: 15182 - RNA, 17 nt, Artificial Sequence
  Synthetic
ugucaauauaccugcaa

SEQ ID NO: 15183 - RNA, 17 nt, Artificial Sequence
  Synthetic
cucaccuucuccaucaa

SEQ ID NO: 15184 - RNA, 17 nt, Artificial Sequence
  Synthetic
cacacuucuaagaucaa

SEQ ID NO: 15185 - RNA, 17 nt, Artificial Sequence
  Synthetic
uggccuuaggaacucaa

SEQ ID NO: 15186 - RNA, 17 nt, Artificial Sequence
  Synthetic
ccaggcccagaucagaa

SEQ ID NO: 15187 - RNA, 17 nt, Artificial Sequence
  Synthetic
aauuaggcuuuauagaa

SEQ ID NO: 15188 - RNA, 17 nt, Artificial Sequence
  Synthetic
acggaaguaauguagaa

SEQ ID NO: 15189 - RNA, 17 nt, Artificial Sequence
  Synthetic
uaaccuuuugauuggaa

SEQ ID NO: 15190 - RNA, 17 nt, Artificial Sequence
  Synthetic
ugacuacaaucuuggaa

SEQ ID NO: 15191 - RNA, 17 nt, Artificial Sequence
  Synthetic
cacgauuuacuucauaa

SEQ ID NO: 15192 - RNA, 17 nt, Artificial Sequence
  Synthetic
ugguaacuugacaguaa

SEQ ID NO: 15193 - RNA, 17 nt, Artificial Sequence
  Synthetic
ucggggaauuucuuuaa

SEQ ID NO: 15194 - RNA, 17 nt, Artificial Sequence
  Synthetic
auguaguuuuaggaaca

SEQ ID NO: 15195 - RNA, 17 nt, Artificial Sequence
  Synthetic
aaauuucaugaaccaca

SEQ ID NO: 15196 - RNA, 17 nt, Artificial Sequence
  Synthetic
ugaaaaagugguccaca

SEQ ID NO: 15197 - RNA, 17 nt, Artificial Sequence
  Synthetic
ugagggccauggucaca

SEQ ID NO: 15198 - RNA, 17 nt, Artificial Sequence
  Synthetic
uaacugccuugugacca

SEQ ID NO: 15199 - RNA, 17 nt, Artificial Sequence
  Synthetic
agacuaugaguggccca

SEQ ID NO: 15200 - RNA, 17 nt, Artificial Sequence
  Synthetic
uaaaacuacauugccca

SEQ ID NO: 15201 - RNA, 17 nt, Artificial Sequence
  Synthetic
uaccuuaagacuuccca

SEQ ID NO: 15202 - RNA, 17 nt, Artificial Sequence
  Synthetic
uuuuucacauuuagcca

SEQ ID NO: 15203 - RNA, 17 nt, Artificial Sequence
  Synthetic
caaccacuugagggcca

SEQ ID NO: 15204 - RNA, 17 nt, Artificial Sequence
  Synthetic
cuggcaaucucuaagca

SEQ ID NO: 15205 - RNA, 17 nt, Artificial Sequence
  Synthetic
accauuccuagagagca

SEQ ID NO: 15206 - RNA, 17 nt, Artificial Sequence
  Synthetic
uaccugaggagaaggca

SEQ ID NO: 15207 - RNA, 17 nt, Artificial Sequence
  Synthetic
ucacacuucuaagauca

SEQ ID NO: 15208 - RNA, 17 nt, Artificial Sequence
  Synthetic
aaaguaucccuaccuca

SEQ ID NO: 15209 - RNA, 17 nt, Artificial Sequence
  Synthetic
ucacaaaauccaucuca

SEQ ID NO: 15210 - RNA, 17 nt, Artificial Sequence
  Synthetic
uuaaggaccacgaaaga

SEQ ID NO: 15211 - RNA, 17 nt, Artificial Sequence
  Synthetic
cucaagugguugccaga

SEQ ID NO: 15212 - RNA, 17 nt, Artificial Sequence
  Synthetic
accaggcccagaucaga

SEQ ID NO: 15213 - RNA, 17 nt, Artificial Sequence
  Synthetic
uaauuaggcuuuauaga

SEQ ID NO: 15214 - RNA, 17 nt, Artificial Sequence
  Synthetic
uaaccaaauguuaugga

SEQ ID NO: 15215 - RNA, 17 nt, Artificial Sequence
  Synthetic
ugccaguuaaugaauga

SEQ ID NO: 15216 - RNA, 17 nt, Artificial Sequence
  Synthetic
aucuggcaaccacuuga

SEQ ID NO: 15217 - RNA, 17 nt, Artificial Sequence
  Synthetic
ucauuagcaagcuucua

SEQ ID NO: 15218 - RNA, 17 nt, Artificial Sequence
  Synthetic
ucucagcuccugaagua

SEQ ID NO: 15219 - RNA, 17 nt, Artificial Sequence
  Synthetic
aaugauuaaucagagua

SEQ ID NO: 15220 - RNA, 17 nt, Artificial Sequence
  Synthetic
agagccauguuuacuua

SEQ ID NO: 15221 - RNA, 17 nt, Artificial Sequence
  Synthetic
cucccugggaagucuua

SEQ ID NO: 15222 - RNA, 17 nt, Artificial Sequence
  Synthetic
ugaguaaccaaauguua

SEQ ID NO: 15223 - RNA, 17 nt, Artificial Sequence
  Synthetic
cuuugcuccuaucuuua

SEQ ID NO: 15224 - RNA, 17 nt, Artificial Sequence
  Synthetic
aacugagagauucuuua

SEQ ID NO: 15225 - RNA, 17 nt, Artificial Sequence
  Synthetic
uuaaauagucugaaaac

SEQ ID NO: 15226 - RNA, 17 nt, Artificial Sequence
  Synthetic
agaccuagguggagaac

SEQ ID NO: 15227 - RNA, 17 nt, Artificial Sequence
  Synthetic
ucuaccuggcauguaac

SEQ ID NO: 15228 - RNA, 17 nt, Artificial Sequence
  Synthetic
cuccaucauucauuaac

SEQ ID NO: 15229 - RNA, 17 nt, Artificial Sequence
  Synthetic
ucucgugccaacagcac

SEQ ID NO: 15230 - RNA, 17 nt, Artificial Sequence
  Synthetic
cuuaagguaauggcuac

SEQ ID NO: 15231 - RNA, 17 nt, Artificial Sequence
  Synthetic
cucuccagcaaugcuac

SEQ ID NO: 15232 - RNA, 17 nt, Artificial Sequence
  Synthetic
aacguauggguuuguac

SEQ ID NO: 15233 - RNA, 17 nt, Artificial Sequence
  Synthetic
agcaaagaguucuaacc

SEQ ID NO: 15234 - RNA, 17 nt, Artificial Sequence
  Synthetic
auaaggcaaaugccacc

SEQ ID NO: 15235 - RNA, 17 nt, Artificial Sequence
  Synthetic
aggacucaaaugccacc

SEQ ID NO: 15236 - RNA, 17 nt, Artificial Sequence
  Synthetic
agugaaguagagagacc

SEQ ID NO: 15237 - RNA, 17 nt, Artificial Sequence
  Synthetic
uaguaggaccacauacc

SEQ ID NO: 15238 - RNA, 17 nt, Artificial Sequence
  Synthetic
agaggagauauucuacc

SEQ ID NO: 15239 - RNA, 17 nt, Artificial Sequence
  Synthetic
cccuugggaagugaccc

SEQ ID NO: 15240 - RNA, 17 nt, Artificial Sequence
  Synthetic
cuaaaacuacauugccc

SEQ ID NO: 15241 - RNA, 17 nt, Artificial Sequence
  Synthetic
aauacaaauguacuccc

SEQ ID NO: 15242 - RNA, 17 nt, Artificial Sequence
  Synthetic
uacauaaaguggguccc

SEQ ID NO: 15243 - RNA, 17 nt, Artificial Sequence
  Synthetic
uuaccuuaagacuuccc

SEQ ID NO: 15244 - RNA, 17 nt, Artificial Sequence
  Synthetic
uuaugaaaugugaagcc

SEQ ID NO: 15245 - RNA, 17 nt, Artificial Sequence
  Synthetic
uaaaggaguaauaggcc

SEQ ID NO: 15246 - RNA, 17 nt, Artificial Sequence
  Synthetic
caugcuuagagauugcc

SEQ ID NO: 15247 - RNA, 17 nt, Artificial Sequence
  Synthetic
acuuagauauucaaagc

SEQ ID NO: 15248 - RNA, 17 nt, Artificial Sequence
  Synthetic
cacuuuauguagaaagc

SEQ ID NO: 15249 - RNA, 17 nt, Artificial Sequence
  Synthetic
uguucaauaauagaagc

SEQ ID NO: 15250 - RNA, 17 nt, Artificial Sequence
  Synthetic
uaauaaauacaaucagc

SEQ ID NO: 15251 - RNA, 17 nt, Artificial Sequence
  Synthetic
cuaaaggaguaauaggc

SEQ ID NO: 15252 - RNA, 17 nt, Artificial Sequence
  Synthetic
auuaaucagaguagggc

SEQ ID NO: 15253 - RNA, 17 nt, Artificial Sequence
  Synthetic
uggcauuugccuuaugc

SEQ ID NO: 15254 - RNA, 17 nt, Artificial Sequence
  Synthetic
uaaacauaauccauugc

SEQ ID NO: 15255 - RNA, 17 nt, Artificial Sequence
  Synthetic
aauguucuucaaccauc

SEQ ID NO: 15256 - RNA, 17 nt, Artificial Sequence
  Synthetic
cccuuuuaucuggcauc

SEQ ID NO: 15257 - RNA, 17 nt, Artificial Sequence
  Synthetic
aagaacauuaaccuauc

SEQ ID NO: 15258 - RNA, 17 nt, Artificial Sequence
  Synthetic
ucacucacccuuuuauc

SEQ ID NO: 15259 - RNA, 17 nt, Artificial Sequence
  Synthetic
uaugacucaagagucuc

SEQ ID NO: 15260 - RNA, 17 nt, Artificial Sequence
  Synthetic
uauguagaaagcugguc

SEQ ID NO: 15261 - RNA, 17 nt, Artificial Sequence
  Synthetic
aggucuucacauaguuc

SEQ ID NO: 15262 - RNA, 17 nt, Artificial Sequence
  Synthetic
cagcuuucuacauaaag

SEQ ID NO: 15263 - RNA, 17 nt, Artificial Sequence
  Synthetic
acuaugaguggcccaag

SEQ ID NO: 15264 - RNA, 17 nt, Artificial Sequence
  Synthetic
ugaccauggcccucaag

SEQ ID NO: 15265 - RNA, 17 nt, Artificial Sequence
  Synthetic
uuguuauauuucauaag

SEQ ID NO: 15266 - RNA, 17 nt, Artificial Sequence
  Synthetic
acuucccaagggugcag

SEQ ID NO: 15267 - RNA, 17 nt, Artificial Sequence
  Synthetic
augcuuuccacucagag

SEQ ID NO: 15268 - RNA, 17 nt, Artificial Sequence
  Synthetic
ucauucuagacuaugag

SEQ ID NO: 15269 - RNA, 17 nt, Artificial Sequence
  Synthetic
ucaaagaauuaagcuag

SEQ ID NO: 15270 - RNA, 17 nt, Artificial Sequence
  Synthetic
cauuagcaagcuucuag

SEQ ID NO: 15271 - RNA, 17 nt, Artificial Sequence
  Synthetic
acacugcaguuauguag

SEQ ID NO: 15272 - RNA, 17 nt, Artificial Sequence
  Synthetic
aaaggaguaauaggccg

SEQ ID NO: 15273 - RNA, 17 nt, Artificial Sequence
  Synthetic
aggagaaggcaaggucg

SEQ ID NO: 15274 - RNA, 17 nt, Artificial Sequence
  Synthetic
aagggcuccuucuuucg

SEQ ID NO: 15275 - RNA, 17 nt, Artificial Sequence
  Synthetic
cuaugugaagaccuagg

SEQ ID NO: 15276 - RNA, 17 nt, Artificial Sequence
  Synthetic
agagauucuuuaugggg

SEQ ID NO: 15277 - RNA, 17 nt, Artificial Sequence
  Synthetic
uggagaagcaugugggg

SEQ ID NO: 15278 - RNA, 17 nt, Artificial Sequence
  Synthetic
caaauguuauggauggg

SEQ ID NO: 15279 - RNA, 17 nt, Artificial Sequence
  Synthetic
uaguuuuaggaacaugg

SEQ ID NO: 15280 - RNA, 17 nt, Artificial Sequence
  Synthetic
ugagagauucuuuaugg

SEQ ID NO: 15281 - RNA, 17 nt, Artificial Sequence
  Synthetic
acucaaaugccaccugg

SEQ ID NO: 15282 - RNA, 17 nt, Artificial Sequence
  Synthetic
uaaauugaaucaacaug

SEQ ID NO: 15283 - RNA, 17 nt, Artificial Sequence
  Synthetic
ugugugcaaaugccaug

SEQ ID NO: 15284 - RNA, 17 nt, Artificial Sequence
  Synthetic
aaagguggagaagcaug

SEQ ID NO: 15285 - RNA, 17 nt, Artificial Sequence
  Synthetic
aaugggguaguuaccug

SEQ ID NO: 15286 - RNA, 17 nt, Artificial Sequence
  Synthetic
agccaugauuccagcug

SEQ ID NO: 15287 - RNA, 17 nt, Artificial Sequence
  Synthetic
ucuacauuacuuccgug

SEQ ID NO: 15288 - RNA, 17 nt, Artificial Sequence
  Synthetic
aucuuggaacggaugug

SEQ ID NO: 15289 - RNA, 17 nt, Artificial Sequence
  Synthetic
caucuggcaaccacuug

SEQ ID NO: 15290 - RNA, 17 nt, Artificial Sequence
  Synthetic
ccuauucuaggcacuug

SEQ ID NO: 15291 - RNA, 17 nt, Artificial Sequence
  Synthetic
uaccuaguucuuccuug

SEQ ID NO: 15292 - RNA, 17 nt, Artificial Sequence
  Synthetic
uuggugcuaacaauuug

SEQ ID NO: 15293 - RNA, 17 nt, Artificial Sequence
  Synthetic
uacuuaagcuaguaaau

SEQ ID NO: 15294 - RNA, 17 nt, Artificial Sequence
  Synthetic
ccccaagugccuagaau

SEQ ID NO: 15295 - RNA, 17 nt, Artificial Sequence
  Synthetic
cacucuaaaggaguaau

SEQ ID NO: 15296 - RNA, 17 nt, Artificial Sequence
  Synthetic
cggggaauuucuuuaau

SEQ ID NO: 15297 - RNA, 17 nt, Artificial Sequence
  Synthetic
ucgugguccuuaaagau

SEQ ID NO: 15298 - RNA, 17 nt, Artificial Sequence
  Synthetic
acaaaauugagccagau

SEQ ID NO: 15299 - RNA, 17 nt, Artificial Sequence
  Synthetic
uggggagggaaauagau

SEQ ID NO: 15300 - RNA, 17 nt, Artificial Sequence
  Synthetic
aaccaaauguuauggau

SEQ ID NO: 15301 - RNA, 17 nt, Artificial Sequence
  Synthetic
aaaauaauagaacguau

SEQ ID NO: 15302 - RNA, 17 nt, Artificial Sequence
  Synthetic
aaaaggaacgaauuuau

SEQ ID NO: 15303 - RNA, 17 nt, Artificial Sequence
  Synthetic
acugagagauucuuuau

SEQ ID NO: 15304 - RNA, 17 nt, Artificial Sequence
  Synthetic
aaccacaaggaagaacu

SEQ ID NO: 15305 - RNA, 17 nt, Artificial Sequence
  Synthetic
auagucuagaaugaacu

SEQ ID NO: 15306 - RNA, 17 nt, Artificial Sequence
  Synthetic
aggccaguucuccaccu

SEQ ID NO: 15307 - RNA, 17 nt, Artificial Sequence
  Synthetic
uuguaccucugcacccu

SEQ ID NO: 15308 - RNA, 17 nt, Artificial Sequence
  Synthetic
aggucucuagugacccu

SEQ ID NO: 15309 - RNA, 17 nt, Artificial Sequence
  Synthetic
ucauagugcuuaccccu

SEQ ID NO: 15310 - RNA, 17 nt, Artificial Sequence
  Synthetic
auacaaauguacucccu

SEQ ID NO: 15311 - RNA, 17 nt, Artificial Sequence
  Synthetic
uguacacaccccuuccu

SEQ ID NO: 15312 - RNA, 17 nt, Artificial Sequence
  Synthetic
cuuagauauucaaagcu

SEQ ID NO: 15313 - RNA, 17 nt, Artificial Sequence
  Synthetic
uuaaucagaguagggcu

SEQ ID NO: 15314 - RNA, 17 nt, Artificial Sequence
  Synthetic
uauccugacuacaaucu

SEQ ID NO: 15315 - RNA, 17 nt, Artificial Sequence
  Synthetic
ucucuaagcauggaucu

SEQ ID NO: 15316 - RNA, 17 nt, Artificial Sequence
  Synthetic
accacaucaccuacucu

SEQ ID NO: 15317 - RNA, 17 nt, Artificial Sequence
  Synthetic
augacucaagagucucu

SEQ ID NO: 15318 - RNA, 17 nt, Artificial Sequence
  Synthetic
cucauuagcaagcuucu

SEQ ID NO: 15319 - RNA, 17 nt, Artificial Sequence
  Synthetic
uuguuagcaccaagagu

SEQ ID NO: 15320 - RNA, 17 nt, Artificial Sequence
  Synthetic
caaagaauuaagcuagu

SEQ ID NO: 15321 - RNA, 17 nt, Artificial Sequence
  Synthetic
aagguggagaagcaugu

SEQ ID NO: 15322 - RNA, 17 nt, Artificial Sequence
  Synthetic
caucaggccugugcugu

SEQ ID NO: 15323 - RNA, 17 nt, Artificial Sequence
  Synthetic
cauugaacccauuuugu

SEQ ID NO: 15324 - RNA, 17 nt, Artificial Sequence
  Synthetic
acuuaagcuaguaaauu

SEQ ID NO: 15325 - RNA, 17 nt, Artificial Sequence
  Synthetic
cucccauccauaacauu

SEQ ID NO: 15326 - RNA, 17 nt, Artificial Sequence
  Synthetic
uguaccucugcacccuu

SEQ ID NO: 15327 - RNA, 17 nt, Artificial Sequence
  Synthetic
cauagugcuuaccccuu

SEQ ID NO: 15328 - RNA, 17 nt, Artificial Sequence
  Synthetic
uuuccaaucaaaagguu

SEQ ID NO: 15329 - RNA, 20 nt, Artificial Sequence
  Synthetic
aggccugaugccagauaaaa

SEQ ID NO: 15330 - RNA, 20 nt, Artificial Sequence
  Synthetic
cuucuccaucaaaggagaaa

SEQ ID NO: 15331 - RNA, 20 nt, Artificial Sequence
  Synthetic
auccaugauggaaugugaaa

SEQ ID NO: 15332 - RNA, 20 nt, Artificial Sequence
  Synthetic
caggccugaugccagauaaa

SEQ ID NO: 15333 - RNA, 20 nt, Artificial Sequence
  Synthetic
agccuuuuuucucuucacaa

SEQ ID NO: 15334 - RNA, 20 nt, Artificial Sequence
  Synthetic
cuagguaaacaauuagacaa

SEQ ID NO: 15335 - RNA, 20 nt, Artificial Sequence
  Synthetic
ucacauuuagccaaggacaa

SEQ ID NO: 15336 - RNA, 20 nt, Artificial Sequence
  Synthetic
cuagacuaugaguggcccaa

SEQ ID NO: 15337 - RNA, 20 nt, Artificial Sequence
  Synthetic
aagccagggucacuucccaa

SEQ ID NO: 15338 - RNA, 20 nt, Artificial Sequence
  Synthetic
acuugucaauauaccugcaa

SEQ ID NO: 15339 - RNA, 20 nt, Artificial Sequence
  Synthetic
agacucaccuucuccaucaa

SEQ ID NO: 15340 - RNA, 20 nt, Artificial Sequence
  Synthetic
auucacacuucuaagaucaa

SEQ ID NO: 15341 - RNA, 20 nt, Artificial Sequence
  Synthetic
aacuggccuuaggaacucaa

SEQ ID NO: 15342 - RNA, 20 nt, Artificial Sequence
  Synthetic
auaccaggcccagaucagaa

SEQ ID NO: 15343 - RNA, 20 nt, Artificial Sequence
  Synthetic
uagcucugugugugagagaa

SEQ ID NO: 15344 - RNA, 20 nt, Artificial Sequence
  Synthetic
cacacggaaguaauguagaa

SEQ ID NO: 15345 - RNA, 20 nt, Artificial Sequence
  Synthetic
auugccuugcucucuaggaa

SEQ ID NO: 15346 - RNA, 20 nt, Artificial Sequence
  Synthetic
uccuaaccuuuugauuggaa

SEQ ID NO: 15347 - RNA, 20 nt, Artificial Sequence
  Synthetic
uccugacuacaaucuuggaa

SEQ ID NO: 15348 - RNA, 20 nt, Artificial Sequence
  Synthetic
cagauaaaagggugagugaa

SEQ ID NO: 15349 - RNA, 20 nt, Artificial Sequence
  Synthetic
auacacgauuuacuucauaa

SEQ ID NO: 15350 - RNA, 20 nt, Artificial Sequence
  Synthetic
auggcucuaaaucacucuaa

SEQ ID NO: 15351 - RNA, 20 nt, Artificial Sequence
  Synthetic
uuaugguaacuugacaguaa

SEQ ID NO: 15352 - RNA, 20 nt, Artificial Sequence
  Synthetic
ccugggaagucuuaagguaa

SEQ ID NO: 15353 - RNA, 20 nt, Artificial Sequence
  Synthetic
cuacuaaaaucauguauuaa

SEQ ID NO: 15354 - RNA, 20 nt, Artificial Sequence
  Synthetic
aggucggggaauuucuuuaa

SEQ ID NO: 15355 - RNA, 20 nt, Artificial Sequence
  Synthetic
caaguuaccauaaguaaaca

SEQ ID NO: 15356 - RNA, 20 nt, Artificial Sequence
  Synthetic
augugaaaaagugguccaca

SEQ ID NO: 15357 - RNA, 20 nt, Artificial Sequence
  Synthetic
acuugagggccauggucaca

SEQ ID NO: 15358 - RNA, 20 nt, Artificial Sequence
  Synthetic
uuaggaacucaaugggacca

SEQ ID NO: 15359 - RNA, 20 nt, Artificial Sequence
  Synthetic
ucauaacugccuugugacca

SEQ ID NO: 15360 - RNA, 20 nt, Artificial Sequence
  Synthetic
cuggcucaauuuugugacca

SEQ ID NO: 15361 - RNA, 20 nt, Artificial Sequence
  Synthetic
ucuagacuaugaguggccca

SEQ ID NO: 15362 - RNA, 20 nt, Artificial Sequence
  Synthetic
uccuaaaacuacauugccca

SEQ ID NO: 15363 - RNA, 20 nt, Artificial Sequence
  Synthetic
cauuaccuuaagacuuccca

SEQ ID NO: 15364 - RNA, 20 nt, Artificial Sequence
  Synthetic
aguuaugaaaugugaagcca

SEQ ID NO: 15365 - RNA, 20 nt, Artificial Sequence
  Synthetic
uggcaaccacuugagggcca

SEQ ID NO: 15366 - RNA, 20 nt, Artificial Sequence
  Synthetic
uauguagaggauucaaucca

SEQ ID NO: 15367 - RNA, 20 nt, Artificial Sequence
  Synthetic
agccuggcaaucucuaagca

SEQ ID NO: 15368 - RNA, 20 nt, Artificial Sequence
  Synthetic
acuaccauuccuagagagca

SEQ ID NO: 15369 - RNA, 20 nt, Artificial Sequence
  Synthetic
aguuaccugaggagaaggca

SEQ ID NO: 15370 - RNA, 20 nt, Artificial Sequence
  Synthetic
acagaccucagcuggaauca

SEQ ID NO: 15371 - RNA, 20 nt, Artificial Sequence
  Synthetic
agccauuucacauuccauca

SEQ ID NO: 15372 - RNA, 20 nt, Artificial Sequence
  Synthetic
aacaaaguaucccuaccuca

SEQ ID NO: 15373 - RNA, 20 nt, Artificial Sequence
  Synthetic
uuuucacaaaauccaucuca

SEQ ID NO: 15374 - RNA, 20 nt, Artificial Sequence
  Synthetic
ucuuuaaggaccacgaaaga

SEQ ID NO: 15375 - RNA, 20 nt, Artificial Sequence
  Synthetic
cauaccaggcccagaucaga

SEQ ID NO: 15376 - RNA, 20 nt, Artificial Sequence
  Synthetic
caaaggagaaauggaucaga

SEQ ID NO: 15377 - RNA, 20 nt, Artificial Sequence
  Synthetic
ucuuauuagagaccaugaga

SEQ ID NO: 15378 - RNA, 20 nt, Artificial Sequence
  Synthetic
cauguggggagggaaauaga

SEQ ID NO: 15379 - RNA, 20 nt, Artificial Sequence
  Synthetic
agguaauuaggcuuuauaga

SEQ ID NO: 15380 - RNA, 20 nt, Artificial Sequence
  Synthetic
ucagaugggaaagccaagga

SEQ ID NO: 15381 - RNA, 20 nt, Artificial Sequence
  Synthetic
cuuugccaguuaaugaauga

SEQ ID NO: 15382 - RNA, 20 nt, Artificial Sequence
  Synthetic
aaguuuuaauuggaugcuga

SEQ ID NO: 15383 - RNA, 20 nt, Artificial Sequence
  Synthetic
ccagauaaaagggugaguga

SEQ ID NO: 15384 - RNA, 20 nt, Artificial Sequence
  Synthetic
accaucuggcaaccacuuga

SEQ ID NO: 15385 - RNA, 20 nt, Artificial Sequence
  Synthetic
cugauccauuucuccuuuga

SEQ ID NO: 15386 - RNA, 20 nt, Artificial Sequence
  Synthetic
uccuuuuuuuggcauuuuga

SEQ ID NO: 15387 - RNA, 20 nt, Artificial Sequence
  Synthetic
ucagaguaagaagcuaaaua

SEQ ID NO: 15388 - RNA, 20 nt, Artificial Sequence
  Synthetic
auccccaagugccuagaaua

SEQ ID NO: 15389 - RNA, 20 nt, Artificial Sequence
  Synthetic
uuggucccauugaguuccua

SEQ ID NO: 15390 - RNA, 20 nt, Artificial Sequence
  Synthetic
cucucauuagcaagcuucua

SEQ ID NO: 15391 - RNA, 20 nt, Artificial Sequence
  Synthetic
acaucucagcuccugaagua

SEQ ID NO: 15392 - RNA, 20 nt, Artificial Sequence
  Synthetic
ugugcaaaugccaugaggua

SEQ ID NO: 15393 - RNA, 20 nt, Artificial Sequence
  Synthetic
uuuagagccauguuuacuua

SEQ ID NO: 15394 - RNA, 20 nt, Artificial Sequence
  Synthetic
cucugaguaaccaaauguua

SEQ ID NO: 15395 - RNA, 20 nt, Artificial Sequence
  Synthetic
acucuuugcuccuaucuuua

SEQ ID NO: 15396 - RNA, 20 nt, Artificial Sequence
  Synthetic
acauuaaauagucugaaaac

SEQ ID NO: 15397 - RNA, 20 nt, Artificial Sequence
  Synthetic
augggggauacagugaaaac

SEQ ID NO: 15398 - RNA, 20 nt, Artificial Sequence
  Synthetic
ugaagaccuagguggagaac

SEQ ID NO: 15399 - RNA, 20 nt, Artificial Sequence
  Synthetic
uauucuaccuggcauguaac

SEQ ID NO: 15400 - RNA, 20 nt, Artificial Sequence
  Synthetic
uggcuccaucauucauuaac

SEQ ID NO: 15401 - RNA, 20 nt, Artificial Sequence
  Synthetic
cugguuuuauuuucucagac

SEQ ID NO: 15402 - RNA, 20 nt, Artificial Sequence
  Synthetic
agucuuaagguaauggcuac

SEQ ID NO: 15403 - RNA, 20 nt, Artificial Sequence
  Synthetic
uaucucuccagcaaugcuac

SEQ ID NO: 15404 - RNA, 20 nt, Artificial Sequence
  Synthetic
uagaacguauggguuuguac

SEQ ID NO: 15405 - RNA, 20 nt, Artificial Sequence
  Synthetic
aggagcaaagaguucuaacc

SEQ ID NO: 15406 - RNA, 20 nt, Artificial Sequence
  Synthetic
agcauaaggcaaaugccacc

SEQ ID NO: 15407 - RNA, 20 nt, Artificial Sequence
  Synthetic
ccaaggacucaaaugccacc

SEQ ID NO: 15408 - RNA, 20 nt, Artificial Sequence
  Synthetic
uucuaguaggaccacauacc

SEQ ID NO: 15409 - RNA, 20 nt, Artificial Sequence
  Synthetic
cugagaggagauauucuacc

SEQ ID NO: 15410 - RNA, 20 nt, Artificial Sequence
  Synthetic
uaagaggucucuagugaccc

SEQ ID NO: 15411 - RNA, 20 nt, Artificial Sequence
  Synthetic
uuccuaaaacuacauugccc

SEQ ID NO: 15412 - RNA, 20 nt, Artificial Sequence
  Synthetic
uugaauacaaauguacuccc

SEQ ID NO: 15413 - RNA, 20 nt, Artificial Sequence
  Synthetic
uucuacauaaaguggguccc

SEQ ID NO: 15414 - RNA, 20 nt, Artificial Sequence
  Synthetic
ccauuaccuuaagacuuccc

SEQ ID NO: 15415 - RNA, 20 nt, Artificial Sequence
  Synthetic
caguuaugaaaugugaagcc

SEQ ID NO: 15416 - RNA, 20 nt, Artificial Sequence
  Synthetic
cuucccuucugaucugggcc

SEQ ID NO: 15417 - RNA, 20 nt, Artificial Sequence
  Synthetic
auccaugcuuagagauugcc

SEQ ID NO: 15418 - RNA, 20 nt, Artificial Sequence
  Synthetic
aaaacuuagauauucaaagc

SEQ ID NO: 15419 - RNA, 20 nt, Artificial Sequence
  Synthetic
acccacuuuauguagaaagc

SEQ ID NO: 15420 - RNA, 20 nt, Artificial Sequence
  Synthetic
aaguguucaauaauagaagc

SEQ ID NO: 15421 - RNA, 20 nt, Artificial Sequence
  Synthetic
acuuaauaaauacaaucagc

SEQ ID NO: 15422 - RNA, 20 nt, Artificial Sequence
  Synthetic
aaggcaauacagaccucagc

SEQ ID NO: 15423 - RNA, 20 nt, Artificial Sequence
  Synthetic
augauuaaucagaguagggc

SEQ ID NO: 15424 - RNA, 20 nt, Artificial Sequence
  Synthetic
auauaaacauaauccauugc

SEQ ID NO: 15425 - RNA, 20 nt, Artificial Sequence
  Synthetic
auagaaaccuguagcauugc

SEQ ID NO: 15426 - RNA, 20 nt, Artificial Sequence
  Synthetic
aaacuucuucccuucugauc

SEQ ID NO: 15427 - RNA, 20 nt, Artificial Sequence
  Synthetic
uugaagaacauuaaccuauc

SEQ ID NO: 15428 - RNA, 20 nt, Artificial Sequence
  Synthetic
ucagauucauguucucuauc

SEQ ID NO: 15429 - RNA, 20 nt, Artificial Sequence
  Synthetic
ucugaauuugcagaauuauc

SEQ ID NO: 15430 - RNA, 20 nt, Artificial Sequence
  Synthetic
cccgaccuugccuucuccuc

SEQ ID NO: 15431 - RNA, 20 nt, Artificial Sequence
  Synthetic
cacuaugacucaagagucuc

SEQ ID NO: 15432 - RNA, 20 nt, Artificial Sequence
  Synthetic
uccguuccaagauuguaguc

SEQ ID NO: 15433 - RNA, 20 nt, Artificial Sequence
  Synthetic
ccugaggagaaggcaagguc

SEQ ID NO: 15434 - RNA, 20 nt, Artificial Sequence
  Synthetic
cuuuauguagaaagcugguc

SEQ ID NO: 15435 - RNA, 20 nt, Artificial Sequence
  Synthetic
ccuaggucuucacauaguuc

SEQ ID NO: 15436 - RNA, 20 nt, Artificial Sequence
  Synthetic
auggguucaaugugaaaaag

SEQ ID NO: 15437 - RNA, 20 nt, Artificial Sequence
  Synthetic
uagacuaugaguggcccaag

SEQ ID NO: 15438 - RNA, 20 nt, Artificial Sequence
  Synthetic
uugugaccauggcccucaag

SEQ ID NO: 15439 - RNA, 20 nt, Artificial Sequence
  Synthetic
cuuucauuaacagaaaucag

SEQ ID NO: 15440 - RNA, 20 nt, Artificial Sequence
  Synthetic
aaggcuuuacguuucaucag

SEQ ID NO: 15441 - RNA, 20 nt, Artificial Sequence
  Synthetic
augaugcuuuccacucagag

SEQ ID NO: 15442 - RNA, 20 nt, Artificial Sequence
  Synthetic
aguucauucuagacuaugag

SEQ ID NO: 15443 - RNA, 20 nt, Artificial Sequence
  Synthetic
uuccacucagaguggcugag

SEQ ID NO: 15444 - RNA, 20 nt, Artificial Sequence
  Synthetic
cuccucucagccacucugag

SEQ ID NO: 15445 - RNA, 20 nt, Artificial Sequence
  Synthetic
uauucaaagaauuaagcuag

SEQ ID NO: 15446 - RNA, 20 nt, Artificial Sequence
  Synthetic
ucucauuagcaagcuucuag

SEQ ID NO: 15447 - RNA, 20 nt, Artificial Sequence
  Synthetic
ugcacacugcaguuauguag

SEQ ID NO: 15448 - RNA, 20 nt, Artificial Sequence
  Synthetic
ucuaaaggaguaauaggccg

SEQ ID NO: 15449 - RNA, 20 nt, Artificial Sequence
  Synthetic
cugaggagaaggcaaggucg

SEQ ID NO: 15450 - RNA, 20 nt, Artificial Sequence
  Synthetic
auaaggcaaaugccaccagg

SEQ ID NO: 15451 - RNA, 20 nt, Artificial Sequence
  Synthetic
cugagagauucuuuaugggg

SEQ ID NO: 15452 - RNA, 20 nt, Artificial Sequence
  Synthetic
aaccaaauguuauggauggg

SEQ ID NO: 15453 - RNA, 20 nt, Artificial Sequence
  Synthetic
acugagagauucuuuauggg

SEQ ID NO: 15454 - RNA, 20 nt, Artificial Sequence
  Synthetic
uuuaaauugaaucaacaugg

SEQ ID NO: 15455 - RNA, 20 nt, Artificial Sequence
  Synthetic
auguaguuuuaggaacaugg

SEQ ID NO: 15456 - RNA, 20 nt, Artificial Sequence
  Synthetic
aacugagagauucuuuaugg

SEQ ID NO: 15457 - RNA, 20 nt, Artificial Sequence
  Synthetic
aggacucaaaugccaccugg

SEQ ID NO: 15458 - RNA, 20 nt, Artificial Sequence
  Synthetic
uuuuaaauugaaucaacaug

SEQ ID NO: 15459 - RNA, 20 nt, Artificial Sequence
  Synthetic
agcaccaagaguaggugaug

SEQ ID NO: 15460 - RNA, 20 nt, Artificial Sequence
  Synthetic
ucugaucugggccugguaug

SEQ ID NO: 15461 - RNA, 20 nt, Artificial Sequence
  Synthetic
aaacugagagauucuuuaug

SEQ ID NO: 15462 - RNA, 20 nt, Artificial Sequence
  Synthetic
uagaaugggguaguuaccug

SEQ ID NO: 15463 - RNA, 20 nt, Artificial Sequence
  Synthetic
uggagccaugauuccagcug

SEQ ID NO: 15464 - RNA, 20 nt, Artificial Sequence
  Synthetic
uaaguuuuaauuggaugcug

SEQ ID NO: 15465 - RNA, 20 nt, Artificial Sequence
  Synthetic
cuuucuacauuacuuccgug

SEQ ID NO: 15466 - RNA, 20 nt, Artificial Sequence
  Synthetic
acaaucuuggaacggaugug

SEQ ID NO: 15467 - RNA, 20 nt, Artificial Sequence
  Synthetic
aaccaucuggcaaccacuug

SEQ ID NO: 15468 - RNA, 20 nt, Artificial Sequence
  Synthetic
cucuuggugcuaacaauuug

SEQ ID NO: 15469 - RNA, 20 nt, Artificial Sequence
  Synthetic
uguacauaaaccaacaaaau

SEQ ID NO: 15470 - RNA, 20 nt, Artificial Sequence
  Synthetic
auuuacuuaagcuaguaaau

SEQ ID NO: 15471 - RNA, 20 nt, Artificial Sequence
  Synthetic
acuggccuuaggaacucaau

SEQ ID NO: 15472 - RNA, 20 nt, Artificial Sequence
  Synthetic
caaguucaaaauaauauaau

SEQ ID NO: 15473 - RNA, 20 nt, Artificial Sequence
  Synthetic
uaugguaacuugacaguaau

SEQ ID NO: 15474 - RNA, 20 nt, Artificial Sequence
  Synthetic
aaucacucuaaaggaguaau

SEQ ID NO: 15475 - RNA, 20 nt, Artificial Sequence
  Synthetic
cuuucgugguccuuaaagau

SEQ ID NO: 15476 - RNA, 20 nt, Artificial Sequence
  Synthetic
aaaggagaaauggaucagau

SEQ ID NO: 15477 - RNA, 20 nt, Artificial Sequence
  Synthetic
auguggggagggaaauagau

SEQ ID NO: 15478 - RNA, 20 nt, Artificial Sequence
  Synthetic
aguaaccaaauguuauggau

SEQ ID NO: 15479 - RNA, 20 nt, Artificial Sequence
  Synthetic
aaggauccuaaccuuuugau

SEQ ID NO: 15480 - RNA, 20 nt, Artificial Sequence
  Synthetic
acaaaaauaauagaacguau

SEQ ID NO: 15481 - RNA, 20 nt, Artificial Sequence
  Synthetic
aauaaaaggaacgaauuuau

SEQ ID NO: 15482 - RNA, 20 nt, Artificial Sequence
  Synthetic
ugggugaaacuugaacaacu

SEQ ID NO: 15483 - RNA, 20 nt, Artificial Sequence
  Synthetic
augaaccacaaggaagaacu

SEQ ID NO: 15484 - RNA, 20 nt, Artificial Sequence
  Synthetic
cucauagucuagaaugaacu

SEQ ID NO: 15485 - RNA, 20 nt, Artificial Sequence
  Synthetic
agcuucuauuauugaacacu

SEQ ID NO: 15486 - RNA, 20 nt, Artificial Sequence
  Synthetic
cuaaggccaguucuccaccu

SEQ ID NO: 15487 - RNA, 20 nt, Artificial Sequence
  Synthetic
ccugaacuaugugaagaccu

SEQ ID NO: 15488 - RNA, 20 nt, Artificial Sequence
  Synthetic
aagaggucucuagugacccu

SEQ ID NO: 15489 - RNA, 20 nt, Artificial Sequence
  Synthetic
ugaauacaaauguacucccu

SEQ ID NO: 15490 - RNA, 20 nt, Artificial Sequence
  Synthetic
ccagguggcauuugaguccu

SEQ ID NO: 15491 - RNA, 20 nt, Artificial Sequence
  Synthetic
aagaaggagcccuuuguccu

SEQ ID NO: 15492 - RNA, 20 nt, Artificial Sequence
  Synthetic
uuauguacacaccccuuccu

SEQ ID NO: 15493 - RNA, 20 nt, Artificial Sequence
  Synthetic
aaacuuagauauucaaagcu

SEQ ID NO: 15494 - RNA, 20 nt, Artificial Sequence
  Synthetic
ugauuaaucagaguagggcu

SEQ ID NO: 15495 - RNA, 20 nt, Artificial Sequence
  Synthetic
ucauauccugacuacaaucu

SEQ ID NO: 15496 - RNA, 20 nt, Artificial Sequence
  Synthetic
caaucucuaagcauggaucu

SEQ ID NO: 15497 - RNA, 20 nt, Artificial Sequence
  Synthetic
aacuucuucccuucugaucu

SEQ ID NO: 15498 - RNA, 20 nt, Artificial Sequence
  Synthetic
agaaccacaucaccuacucu

SEQ ID NO: 15499 - RNA, 20 nt, Artificial Sequence
  Synthetic
ucuguauugccuugcucucu

SEQ ID NO: 15500 - RNA, 20 nt, Artificial Sequence
  Synthetic
acuaugacucaagagucucu

SEQ ID NO: 15501 - RNA, 20 nt, Artificial Sequence
  Synthetic
accagcuuucuacauaaagu

SEQ ID NO: 15502 - RNA, 20 nt, Artificial Sequence
  Synthetic
aaauuguuagcaccaagagu

SEQ ID NO: 15503 - RNA, 20 nt, Artificial Sequence
  Synthetic
agggaaugauuaaucagagu

SEQ ID NO: 15504 - RNA, 20 nt, Artificial Sequence
  Synthetic
auucaaagaauuaagcuagu

SEQ ID NO: 15505 - RNA, 20 nt, Artificial Sequence
  Synthetic
accugaggagaaggcaaggu

SEQ ID NO: 15506 - RNA, 20 nt, Artificial Sequence
  Synthetic
agaaagguggagaagcaugu

SEQ ID NO: 15507 - RNA, 20 nt, Artificial Sequence
  Synthetic
uggcaucaggccugugcugu

SEQ ID NO: 15508 - RNA, 20 nt, Artificial Sequence
  Synthetic
ucacauugaacccauuuugu

SEQ ID NO: 15509 - RNA, 20 nt, Artificial Sequence
  Synthetic
auagaugggaaaagguaauu

SEQ ID NO: 15510 - RNA, 20 nt, Artificial Sequence
  Synthetic
aaccucccauccauaacauu

SEQ ID NO: 15511 - RNA, 20 nt, Artificial Sequence
  Synthetic
ucaacucaauguuuuuacuu

SEQ ID NO: 15512 - RNA, 20 nt, Artificial Sequence
  Synthetic
cuuuguaccucugcacccuu

SEQ ID NO: 15513 - RNA, 20 nt, Artificial Sequence
  Synthetic
agucauagugcuuaccccuu

SEQ ID NO: 15514 - RNA, 20 nt, Artificial Sequence
  Synthetic
cuagguggagaacuggccuu

SEQ ID NO: 15515 - RNA, 20 nt, Artificial Sequence
  Synthetic
uccuuuccaaucaaaagguu

SEQ ID NO: 15516 - RNA, 20 nt, Artificial Sequence
  Synthetic
acccugggcaauguaguuuu

SEQ ID NO: 15517 - RNA, 17 nt, Artificial Sequence
  Synthetic
gggaaauagaugggaaa

SEQ ID NO: 15518 - RNA, 17 nt, Artificial Sequence
  Synthetic
gaccagccuggccaaca

SEQ ID NO: 15519 - RNA, 17 nt, Artificial Sequence
  Synthetic
gcuaauuuuuguagaga

SEQ ID NO: 15520 - RNA, 17 nt, Artificial Sequence
  Synthetic
guggggagggaaauaga

SEQ ID NO: 15521 - RNA, 17 nt, Artificial Sequence
  Synthetic
gaugggaaagccaagga

SEQ ID NO: 15522 - RNA, 17 nt, Artificial Sequence
  Synthetic
guugaaugaauccauga

SEQ ID NO: 15523 - RNA, 17 nt, Artificial Sequence
  Synthetic
gauaaaagggugaguga

SEQ ID NO: 15524 - RNA, 17 nt, Artificial Sequence
  Synthetic
gaguaagaagcuaaaua

SEQ ID NO: 15525 - RNA, 17 nt, Artificial Sequence
  Synthetic
gaauagggccuggcaua

SEQ ID NO: 15526 - RNA, 17 nt, Artificial Sequence
  Synthetic
ggggauacagugaaaac

SEQ ID NO: 15527 - RNA, 17 nt, Artificial Sequence
  Synthetic
guuuuauuuucucagac

SEQ ID NO: 15528 - RNA, 17 nt, Artificial Sequence
  Synthetic
gagaaucacuugaaccc

SEQ ID NO: 15529 - RNA, 17 nt, Artificial Sequence
  Synthetic
gagauucgcuugaaccc

SEQ ID NO: 15530 - RNA, 17 nt, Artificial Sequence
  Synthetic
gucucgcugugucaccc

SEQ ID NO: 15531 - RNA, 17 nt, Artificial Sequence
  Synthetic
ggcgugagccacugccc

SEQ ID NO: 15532 - RNA, 17 nt, Artificial Sequence
  Synthetic
gucuugcucuguugccc

SEQ ID NO: 15533 - RNA, 17 nt, Artificial Sequence
  Synthetic
ggaguucaagaccagcc

SEQ ID NO: 15534 - RNA, 17 nt, Artificial Sequence
  Synthetic
gcaugcaccaccaggcc

SEQ ID NO: 15535 - RNA, 17 nt, Artificial Sequence
  Synthetic
gugccuagaauagggcc

SEQ ID NO: 15536 - RNA, 17 nt, Artificial Sequence
  Synthetic
guuuugcuaugcuggcc

SEQ ID NO: 15537 - RNA, 17 nt, Artificial Sequence
  Synthetic
guuucgccauguuggcc

SEQ ID NO: 15538 - RNA, 17 nt, Artificial Sequence
  Synthetic
gcacucgccacaaugcc

SEQ ID NO: 15539 - RNA, 17 nt, Artificial Sequence
  Synthetic
gaggagaaggcaagguc

SEQ ID NO: 15540 - RNA, 17 nt, Artificial Sequence
  Synthetic
gcagaucacuugagguc

SEQ ID NO: 15541 - RNA, 17 nt, Artificial Sequence
  Synthetic
gguggaaaccauacuuc

SEQ ID NO: 15542 - RNA, 17 nt, Artificial Sequence
  Synthetic
gaaaagaaguaacaggg

SEQ ID NO: 15543 - RNA, 17 nt, Artificial Sequence
  Synthetic
guuuuaauuggaugcug

SEQ ID NO: 15544 - RNA, 17 nt, Artificial Sequence
  Synthetic
ggcgggcagaucacuug

SEQ ID NO: 15545 - RNA, 17 nt, Artificial Sequence
  Synthetic
ggugggcagaucacuug

SEQ ID NO: 15546 - RNA, 17 nt, Artificial Sequence
  Synthetic
gaaagaaaaaauagaau

SEQ ID NO: 15547 - RNA, 17 nt, Artificial Sequence
  Synthetic
guucaaaauaauauaau

SEQ ID NO: 15548 - RNA, 17 nt, Artificial Sequence
  Synthetic
ggagaaauggaucagau

SEQ ID NO: 15549 - RNA, 17 nt, Artificial Sequence
  Synthetic
gcccuauucuaggcacu

SEQ ID NO: 15550 - RNA, 17 nt, Artificial Sequence
  Synthetic
guggaguuucgccaugu

SEQ ID NO: 15551 - RNA, 17 nt, Artificial Sequence
  Synthetic
gaugggaaaagguaauu

SEQ ID NO: 15552 - RNA, 17 nt, Artificial Sequence
  Synthetic
guuuuuuauuuuuuauu

SEQ ID NO: 15553 - RNA, 17 nt, Artificial Sequence
  Synthetic
guguaauggugcaauuu

SEQ ID NO: 15554 - RNA, 20 nt, Artificial Sequence
  Synthetic
ggagggaaauagaugggaaa

SEQ ID NO: 15555 - RNA, 20 nt, Artificial Sequence
  Synthetic
gaaaaauuucaugaaccaca

SEQ ID NO: 15556 - RNA, 20 nt, Artificial Sequence
  Synthetic
gagaaaauaaaaccagcaua

SEQ ID NO: 15557 - RNA, 20 nt, Artificial Sequence
  Synthetic
gacuacaggcaugcaccacc

SEQ ID NO: 15558 - RNA, 20 nt, Artificial Sequence
  Synthetic
gggguuuugcuaugcuggcc

SEQ ID NO: 15559 - RNA, 20 nt, Artificial Sequence
  Synthetic
ggaguuucgccauguuggcc

SEQ ID NO: 15560 - RNA, 20 nt, Artificial Sequence
  Synthetic
gccucagccucucgaguagc

SEQ ID NO: 15561 - RNA, 20 nt, Artificial Sequence
  Synthetic
gcuacucgagaggcugaggc

SEQ ID NO: 15562 - RNA, 20 nt, Artificial Sequence
  Synthetic
gagacgggguuuugcuaugc

SEQ ID NO: 15563 - RNA, 20 nt, Artificial Sequence
  Synthetic
gccuguagucccagcuacuc

SEQ ID NO: 15564 - RNA, 20 nt, Artificial Sequence
  Synthetic
gacuuuguuuuuaaaaguag

SEQ ID NO: 15565 - RNA, 20 nt, Artificial Sequence
  Synthetic
ggcuaauuuuuguagagacg

SEQ ID NO: 15566 - RNA, 20 nt, Artificial Sequence
  Synthetic
gagauucgcuugaacccagg

SEQ ID NO: 15567 - RNA, 20 nt, Artificial Sequence
  Synthetic
gagaaagguggagaagcaug

SEQ ID NO: 15568 - RNA, 20 nt, Artificial Sequence
  Synthetic
gaaagguggagaagcaugug

SEQ ID NO: 15569 - RNA, 20 nt, Artificial Sequence
  Synthetic
ggcccuauucuaggcacuug

SEQ ID NO: 15570 - RNA, 20 nt, Artificial Sequence
  Synthetic
gcaccauuacacuccagccu

SEQ ID NO: 15571 - RNA, 20 nt, Artificial Sequence
  Synthetic
gcauuuugggaggccaaggu

SEQ ID NO: 15572 - RNA, 20 nt, Artificial Sequence
  Synthetic
gugugcaaaugccaugaggu

SEQ ID NO: 15573 - RNA, 20 nt, Artificial Sequence
  Synthetic
gauguggaguuucgccaugu

SEQ ID NO: 15574 - RNA, 20 nt, Artificial Sequence
  Synthetic
gccuuggccucccaaagugu

SEQ ID NO: 15575 - RNA, 20 nt, Artificial Sequence
  Synthetic
ggaguguaauggugcaauuu

SEQ ID NO: 15576 - RNA, 20 nt, Artificial Sequence
  Synthetic
gccacuaaucccaacacuuu

SEQ ID NO: 15577 - RNA, 17 nt, Artificial Sequence
  Synthetic
uucaaaaugccaaaaaa

SEQ ID NO: 15578 - RNA, 17 nt, Artificial Sequence
  Synthetic
cuuugugaagagaaaaa

SEQ ID NO: 15579 - RNA, 17 nt, Artificial Sequence
  Synthetic
uacauaaaccaacaaaa

SEQ ID NO: 15580 - RNA, 17 nt, Artificial Sequence
  Synthetic
uuuccuuuccaaucaaa

SEQ ID NO: 15581 - RNA, 17 nt, Artificial Sequence
  Synthetic
ugucacuggcaaucaaa

SEQ ID NO: 15582 - RNA, 17 nt, Artificial Sequence
  Synthetic
cuccaucaaaggagaaa

SEQ ID NO: 15583 - RNA, 17 nt, Artificial Sequence
  Synthetic
caugauggaaugugaaa

SEQ ID NO: 15584 - RNA, 17 nt, Artificial Sequence
  Synthetic
uagcuuaaguaaauaaa

SEQ ID NO: 15585 - RNA, 17 nt, Artificial Sequence
  Synthetic
cuuuuuucucuucacaa

SEQ ID NO: 15586 - RNA, 17 nt, Artificial Sequence
  Synthetic
cucugugugugagagaa

SEQ ID NO: 15587 - RNA, 17 nt, Artificial Sequence
  Synthetic
ugaaagaaaaaauagaa

SEQ ID NO: 15588 - RNA, 17 nt, Artificial Sequence
  Synthetic
augggaaagccaaggaa

SEQ ID NO: 15589 - RNA, 17 nt, Artificial Sequence
  Synthetic
auaaaagggugagugaa

SEQ ID NO: 15590 - RNA, 17 nt, Artificial Sequence
  Synthetic
acaaacaaaaaacauaa

SEQ ID NO: 15591 - RNA, 17 nt, Artificial Sequence
  Synthetic
uuuguauucaaauauaa

SEQ ID NO: 15592 - RNA, 17 nt, Artificial Sequence
  Synthetic
aguucaaaauaauauaa

SEQ ID NO: 15593 - RNA, 17 nt, Artificial Sequence
  Synthetic
cccaggcuggaguguaa

SEQ ID NO: 15594 - RNA, 17 nt, Artificial Sequence
  Synthetic
cuaaaaucauguauuaa

SEQ ID NO: 15595 - RNA, 17 nt, Artificial Sequence
  Synthetic
uuuaaauugaaucaaca

SEQ ID NO: 15596 - RNA, 17 nt, Artificial Sequence
  Synthetic
uaagaaaagaaguaaca

SEQ ID NO: 15597 - RNA, 17 nt, Artificial Sequence
  Synthetic
aucagaugggaaagcca

SEQ ID NO: 15598 - RNA, 17 nt, Artificial Sequence
  Synthetic
uaugaaaugugaagcca

SEQ ID NO: 15599 - RNA, 17 nt, Artificial Sequence
  Synthetic
aacacuuugggaggcca

SEQ ID NO: 15600 - RNA, 17 nt, Artificial Sequence
  Synthetic
agcauuuugggaggcca

SEQ ID NO: 15601 - RNA, 17 nt, Artificial Sequence
  Synthetic
cauuucacauuccauca

SEQ ID NO: 15602 - RNA, 17 nt, Artificial Sequence
  Synthetic
aggagaaauggaucaga

SEQ ID NO: 15603 - RNA, 17 nt, Artificial Sequence
  Synthetic
uucuccuuugauggaga

SEQ ID NO: 15604 - RNA, 17 nt, Artificial Sequence
  Synthetic
uauuagagaccaugaga

SEQ ID NO: 15605 - RNA, 17 nt, Artificial Sequence
  Synthetic
uuuuaauuggaugcuga

SEQ ID NO: 15606 - RNA, 17 nt, Artificial Sequence
  Synthetic
auccauuucuccuuuga

SEQ ID NO: 15607 - RNA, 17 nt, Artificial Sequence
  Synthetic
uuuuuuuggcauuuuga

SEQ ID NO: 15608 - RNA, 17 nt, Artificial Sequence
  Synthetic
cccaagugccuagaaua

SEQ ID NO: 15609 - RNA, 17 nt, Artificial Sequence
  Synthetic
aaaauaaaaccagcaua

SEQ ID NO: 15610 - RNA, 17 nt, Artificial Sequence
  Synthetic
aaaaauaauagaacgua

SEQ ID NO: 15611 - RNA, 17 nt, Artificial Sequence
  Synthetic
ugauacauuuguauuua

SEQ ID NO: 15612 - RNA, 17 nt, Artificial Sequence
  Synthetic
auaagaaaagaaguaac

SEQ ID NO: 15613 - RNA, 17 nt, Artificial Sequence
  Synthetic
aauuggguuucugucac

SEQ ID NO: 15614 - RNA, 17 nt, Artificial Sequence
  Synthetic
cuaauuuuuguagagac

SEQ ID NO: 15615 - RNA, 17 nt, Artificial Sequence
  Synthetic
ugaguagcugggacuac

SEQ ID NO: 15616 - RNA, 17 nt, Artificial Sequence
  Synthetic
cgaguagcuggguuuac

SEQ ID NO: 15617 - RNA, 17 nt, Artificial Sequence
  Synthetic
uacaggcaugcaccacc

SEQ ID NO: 15618 - RNA, 17 nt, Artificial Sequence
  Synthetic
agauuugaagacaagcc

SEQ ID NO: 15619 - RNA, 17 nt, Artificial Sequence
  Synthetic
accacuacacuccagcc

SEQ ID NO: 15620 - RNA, 17 nt, Artificial Sequence
  Synthetic
accauuacacuccagcc

SEQ ID NO: 15621 - RNA, 17 nt, Artificial Sequence
  Synthetic
aaauacaaaaauuagcc

SEQ ID NO: 15622 - RNA, 17 nt, Artificial Sequence
  Synthetic
cucuacaaaaauuagcc

SEQ ID NO: 15623 - RNA, 17 nt, Artificial Sequence
  Synthetic
caaaaauuagccaggcc

SEQ ID NO: 15624 - RNA, 17 nt, Artificial Sequence
  Synthetic
cccuucugaucugggcc

SEQ ID NO: 15625 - RNA, 17 nt, Artificial Sequence
  Synthetic
aguaccuguuacaugcc

SEQ ID NO: 15626 - RNA, 17 nt, Artificial Sequence
  Synthetic
aguauauaccauaugcc

SEQ ID NO: 15627 - RNA, 17 nt, Artificial Sequence
  Synthetic
cugcaaacucugccucc

SEQ ID NO: 15628 - RNA, 17 nt, Artificial Sequence
  Synthetic
aacauucucugcucucc

SEQ ID NO: 15629 - RNA, 17 nt, Artificial Sequence
  Synthetic
cugcaaacuucgucucc

SEQ ID NO: 15630 - RNA, 17 nt, Artificial Sequence
  Synthetic
ucagccucucgaguagc

SEQ ID NO: 15631 - RNA, 17 nt, Artificial Sequence
  Synthetic
ucagucuccugaguagc

SEQ ID NO: 15632 - RNA, 17 nt, Artificial Sequence
  Synthetic
cuuugggaggccaaggc

SEQ ID NO: 15633 - RNA, 17 nt, Artificial Sequence
  Synthetic
cgcugugucacccaggc

SEQ ID NO: 15634 - RNA, 17 nt, Artificial Sequence
  Synthetic
ugcucuguugcccaggc

SEQ ID NO: 15635 - RNA, 17 nt, Artificial Sequence
  Synthetic
ugcuaugcuggccaggc

SEQ ID NO: 15636 - RNA, 17 nt, Artificial Sequence
  Synthetic
cgccauguuggccaggc

SEQ ID NO: 15637 - RNA, 17 nt, Artificial Sequence
  Synthetic
acucgagaggcugaggc

SEQ ID NO: 15638 - RNA, 17 nt, Artificial Sequence
  Synthetic
uuggccucccaaaaugc

SEQ ID NO: 15639 - RNA, 17 nt, Artificial Sequence
  Synthetic
acgggguuuugcuaugc

SEQ ID NO: 15640 - RNA, 17 nt, Artificial Sequence
  Synthetic
cuucuucccuucugauc

SEQ ID NO: 15641 - RNA, 17 nt, Artificial Sequence
  Synthetic
uguagucccagcuacuc

SEQ ID NO: 15642 - RNA, 17 nt, Artificial Sequence
  Synthetic
ccaaauguguauuuuuc

SEQ ID NO: 15643 - RNA, 17 nt, Artificial Sequence
  Synthetic
ugggaaagccaaggaag

SEQ ID NO: 15644 - RNA, 17 nt, Artificial Sequence
  Synthetic
uaaaagggugagugaag

SEQ ID NO: 15645 - RNA, 17 nt, Artificial Sequence
  Synthetic
ucauuaacagaaaucag

SEQ ID NO: 15646 - RNA, 17 nt, Artificial Sequence
  Synthetic
aaacccagcuacucgag

SEQ ID NO: 15647 - RNA, 17 nt, Artificial Sequence
  Synthetic
cacucagaguggcugag

SEQ ID NO: 15648 - RNA, 17 nt, Artificial Sequence
  Synthetic
cucucagccacucugag

SEQ ID NO: 15649 - RNA, 17 nt, Artificial Sequence
  Synthetic
uucaaagcugggcauag

SEQ ID NO: 15650 - RNA, 17 nt, Artificial Sequence
  Synthetic
uuuguuuuuaaaaguag

SEQ ID NO: 15651 - RNA, 17 nt, Artificial Sequence
  Synthetic
cccaggcuggaguguag

SEQ ID NO: 15652 - RNA, 17 nt, Artificial Sequence
  Synthetic
caaaguguugggauuag

SEQ ID NO: 15653 - RNA, 17 nt, Artificial Sequence
  Synthetic
uaauuuuuguagagacg

SEQ ID NO: 15654 - RNA, 17 nt, Artificial Sequence
  Synthetic
ugugugugagagaaagg

SEQ ID NO: 15655 - RNA, 17 nt, Artificial Sequence
  Synthetic
acuuugggaggccaagg

SEQ ID NO: 15656 - RNA, 17 nt, Artificial Sequence
  Synthetic
auuuugggaggccaagg

SEQ ID NO: 15657 - RNA, 17 nt, Artificial Sequence
  Synthetic
aaaagggugagugaagg

SEQ ID NO: 15658 - RNA, 17 nt, Artificial Sequence
  Synthetic
aggcaaaugccaccagg

SEQ ID NO: 15659 - RNA, 17 nt, Artificial Sequence
  Synthetic
auucgcuugaacccagg

SEQ ID NO: 15660 - RNA, 17 nt, Artificial Sequence
  Synthetic
aaucccaacacuuuggg

SEQ ID NO: 15661 - RNA, 17 nt, Artificial Sequence
  Synthetic
aaucccagcauuuuggg

SEQ ID NO: 15662 - RNA, 17 nt, Artificial Sequence
  Synthetic
aaauugaaucaacaugg

SEQ ID NO: 15663 - RNA, 17 nt, Artificial Sequence
  Synthetic
aaauuagccaggccugg

SEQ ID NO: 15664 - RNA, 17 nt, Artificial Sequence
  Synthetic
aaagaaaaaauagaaug

SEQ ID NO: 15665 - RNA, 17 nt, Artificial Sequence
  Synthetic
uuguauuuuaguagaug

SEQ ID NO: 15666 - RNA, 17 nt, Artificial Sequence
  Synthetic
accaagaguaggugaug

SEQ ID NO: 15667 - RNA, 17 nt, Artificial Sequence
  Synthetic
cugagagauucuuuaug

SEQ ID NO: 15668 - RNA, 17 nt, Artificial Sequence
  Synthetic
uacagaaaagcaaacug

SEQ ID NO: 15669 - RNA, 17 nt, Artificial Sequence
  Synthetic
agcuacucgagaggcug

SEQ ID NO: 15670 - RNA, 17 nt, Artificial Sequence
  Synthetic
agguggagaagcaugug

SEQ ID NO: 15671 - RNA, 17 nt, Artificial Sequence
  Synthetic
aaauuagccaggcauug

SEQ ID NO: 15672 - RNA, 17 nt, Artificial Sequence
  Synthetic
acauaaaccaacaaaau

SEQ ID NO: 15673 - RNA, 17 nt, Artificial Sequence
  Synthetic
uucuuuucuuauaaaau

SEQ ID NO: 15674 - RNA, 17 nt, Artificial Sequence
  Synthetic
uugaauugaaguaaaau

SEQ ID NO: 15675 - RNA, 17 nt, Artificial Sequence
  Synthetic
aauaucuaaguuuuaau

SEQ ID NO: 15676 - RNA, 17 nt, Artificial Sequence
  Synthetic
uuaaauugaaucaacau

SEQ ID NO: 15677 - RNA, 17 nt, Artificial Sequence
  Synthetic
uuucuuuuaaauacuau

SEQ ID NO: 15678 - RNA, 17 nt, Artificial Sequence
  Synthetic
caaaaugcugggauuau

SEQ ID NO: 15679 - RNA, 17 nt, Artificial Sequence
  Synthetic
uguuuuuuauuuuuuau

SEQ ID NO: 15680 - RNA, 17 nt, Artificial Sequence
  Synthetic
uucuauuauugaacacu

SEQ ID NO: 15681 - RNA, 17 nt, Artificial Sequence
  Synthetic
aagugaucugcccaccu

SEQ ID NO: 15682 - RNA, 17 nt, Artificial Sequence
  Synthetic
ccacuacacuccagccu

SEQ ID NO: 15683 - RNA, 17 nt, Artificial Sequence
  Synthetic
ccauuacacuccagccu

SEQ ID NO: 15684 - RNA, 17 nt, Artificial Sequence
  Synthetic
aagugaucugcccgccu

SEQ ID NO: 15685 - RNA, 17 nt, Artificial Sequence
  Synthetic
ugcaaacucugccuccu

SEQ ID NO: 15686 - RNA, 17 nt, Artificial Sequence
  Synthetic
ugcaaacuucgucuccu

SEQ ID NO: 15687 - RNA, 17 nt, Artificial Sequence
  Synthetic
aaggagcccuuuguccu

SEQ ID NO: 15688 - RNA, 17 nt, Artificial Sequence
  Synthetic
cagccucucgaguagcu

SEQ ID NO: 15689 - RNA, 17 nt, Artificial Sequence
  Synthetic
cagucuccugaguagcu

SEQ ID NO: 15690 - RNA, 17 nt, Artificial Sequence
  Synthetic
uggccucccaaaaugcu

SEQ ID NO: 15691 - RNA, 17 nt, Artificial Sequence
  Synthetic
uucuucccuucugaucu

SEQ ID NO: 15692 - RNA, 17 nt, Artificial Sequence
  Synthetic
augccaggcccuauucu

SEQ ID NO: 15693 - RNA, 17 nt, Artificial Sequence
  Synthetic
agcuuucuacauaaagu

SEQ ID NO: 15694 - RNA, 17 nt, Artificial Sequence
  Synthetic
uuuugggaggccaaggu

SEQ ID NO: 15695 - RNA, 17 nt, Artificial Sequence
  Synthetic
ugaggagaaggcaaggu

SEQ ID NO: 15696 - RNA, 17 nt, Artificial Sequence
  Synthetic
ugcaaaugccaugaggu

SEQ ID NO: 15697 - RNA, 17 nt, Artificial Sequence
  Synthetic
uuggccucccaaagugu

SEQ ID NO: 15698 - RNA, 17 nt, Artificial Sequence
  Synthetic
ccugaaaaauacacauu

SEQ ID NO: 15699 - RNA, 17 nt, Artificial Sequence
  Synthetic
cacuaaucccaacacuu

SEQ ID NO: 15700 - RNA, 17 nt, Artificial Sequence
  Synthetic
cccuauucuaggcacuu

SEQ ID NO: 15701 - RNA, 17 nt, Artificial Sequence
  Synthetic
acucaauguuuuuacuu

SEQ ID NO: 15702 - RNA, 17 nt, Artificial Sequence
  Synthetic
uggccucccaaaguguu

SEQ ID NO: 15703 - RNA, 17 nt, Artificial Sequence
  Synthetic
cuauaaucccagcauuu

SEQ ID NO: 15704 - RNA, 17 nt, Artificial Sequence
  Synthetic
aauuuauugaaauauuu

SEQ ID NO: 15705 - RNA, 17 nt, Artificial Sequence
  Synthetic
acuaaucccaacacuuu

SEQ ID NO: 15706 - RNA, 17 nt, Artificial Sequence
  Synthetic
uauaaucccagcauuuu

SEQ ID NO: 15707 - RNA, 17 nt, Artificial Sequence
  Synthetic
cugggcaauguaguuuu

SEQ ID NO: 15708 - RNA, 17 nt, Artificial Sequence
  Synthetic
aauucauuuccuuuuuu

SEQ ID NO: 15709 - RNA, 20 nt, Artificial Sequence
  Synthetic
uuccuuugugaagagaaaaa

SEQ ID NO: 15710 - RNA, 20 nt, Artificial Sequence
  Synthetic
cacauuuagccaaggacaaa

SEQ ID NO: 15711 - RNA, 20 nt, Artificial Sequence
  Synthetic
caguuuccuuuccaaucaaa

SEQ ID NO: 15712 - RNA, 20 nt, Artificial Sequence
  Synthetic
uucugucacuggcaaucaaa

SEQ ID NO: 15713 - RNA, 20 nt, Artificial Sequence
  Synthetic
uacuagcuuaaguaaauaaa

SEQ ID NO: 15714 - RNA, 20 nt, Artificial Sequence
  Synthetic
cuaugaaagaaaaaauagaa

SEQ ID NO: 15715 - RNA, 20 nt, Artificial Sequence
  Synthetic
cagaugggaaagccaaggaa

SEQ ID NO: 15716 - RNA, 20 nt, Artificial Sequence
  Synthetic
caaacaaacaaaaaacauaa

SEQ ID NO: 15717 - RNA, 20 nt, Artificial Sequence
  Synthetic
acauuuguauucaaauauaa

SEQ ID NO: 15718 - RNA, 20 nt, Artificial Sequence
  Synthetic
acaaguucaaaauaauauaa

SEQ ID NO: 15719 - RNA, 20 nt, Artificial Sequence
  Synthetic
uugcccaggcuggaguguaa

SEQ ID NO: 15720 - RNA, 20 nt, Artificial Sequence
  Synthetic
caagaccagccuggccaaca

SEQ ID NO: 15721 - RNA, 20 nt, Artificial Sequence
  Synthetic
uuuuuuaaauugaaucaaca

SEQ ID NO: 15722 - RNA, 20 nt, Artificial Sequence
  Synthetic
uuauaagaaaagaaguaaca

SEQ ID NO: 15723 - RNA, 20 nt, Artificial Sequence
  Synthetic
uggaucagaugggaaagcca

SEQ ID NO: 15724 - RNA, 20 nt, Artificial Sequence
  Synthetic
cccaacacuuugggaggcca

SEQ ID NO: 15725 - RNA, 20 nt, Artificial Sequence
  Synthetic
cccagcauuuugggaggcca

SEQ ID NO: 15726 - RNA, 20 nt, Artificial Sequence
  Synthetic
cuggcuaauuuuuguagaga

SEQ ID NO: 15727 - RNA, 20 nt, Artificial Sequence
  Synthetic
cauuucuccuuugauggaga

SEQ ID NO: 15728 - RNA, 20 nt, Artificial Sequence
  Synthetic
uuuguugaaugaauccauga

SEQ ID NO: 15729 - RNA, 20 nt, Artificial Sequence
  Synthetic
cuagaauagggccuggcaua

SEQ ID NO: 15730 - RNA, 20 nt, Artificial Sequence
  Synthetic
aacaaaaauaauagaacgua

SEQ ID NO: 15731 - RNA, 20 nt, Artificial Sequence
  Synthetic
augugauacauuuguauuua

SEQ ID NO: 15732 - RNA, 20 nt, Artificial Sequence
  Synthetic
uuuauaagaaaagaaguaac

SEQ ID NO: 15733 - RNA, 20 nt, Artificial Sequence
  Synthetic
uggcuaauuuuuguagagac

SEQ ID NO: 15734 - RNA, 20 nt, Artificial Sequence
  Synthetic
uccugaguagcugggacuac

SEQ ID NO: 15735 - RNA, 20 nt, Artificial Sequence
  Synthetic
ucucgaguagcuggguuuac

SEQ ID NO: 15736 - RNA, 20 nt, Artificial Sequence
  Synthetic
caggagaaucacuugaaccc

SEQ ID NO: 15737 - RNA, 20 nt, Artificial Sequence
  Synthetic
acugagauucgcuugaaccc

SEQ ID NO: 15738 - RNA, 20 nt, Artificial Sequence
  Synthetic
agagucucgcugugucaccc

SEQ ID NO: 15739 - RNA, 20 nt, Artificial Sequence
  Synthetic
aguggcgugagccacugccc

SEQ ID NO: 15740 - RNA, 20 nt, Artificial Sequence
  Synthetic
agagucuugcucuguugccc

SEQ ID NO: 15741 - RNA, 20 nt, Artificial Sequence
  Synthetic
cugagauuugaagacaagcc

SEQ ID NO: 15742 - RNA, 20 nt, Artificial Sequence
  Synthetic
ucaggaguucaagaccagcc

SEQ ID NO: 15743 - RNA, 20 nt, Artificial Sequence
  Synthetic
cacaccacuacacuccagcc

SEQ ID NO: 15744 - RNA, 20 nt, Artificial Sequence
  Synthetic
ugcaccauuacacuccagcc

SEQ ID NO: 15745 - RNA, 20 nt, Artificial Sequence
  Synthetic
cuaaaauacaaaaauuagcc

SEQ ID NO: 15746 - RNA, 20 nt, Artificial Sequence
  Synthetic
cgucucuacaaaaauuagcc

SEQ ID NO: 15747 - RNA, 20 nt, Artificial Sequence
  Synthetic
caggcaugcaccaccaggcc

SEQ ID NO: 15748 - RNA, 20 nt, Artificial Sequence
  Synthetic
cuacaaaaauuagccaggcc

SEQ ID NO: 15749 - RNA, 20 nt, Artificial Sequence
  Synthetic
cucuaaaggaguaauaggcc

SEQ ID NO: 15750 - RNA, 20 nt, Artificial Sequence
  Synthetic
caagugccuagaauagggcc

SEQ ID NO: 15751 - RNA, 20 nt, Artificial Sequence
  Synthetic
caggcacucgccacaaugcc

SEQ ID NO: 15752 - RNA, 20 nt, Artificial Sequence
  Synthetic
uugaguaccuguuacaugcc

SEQ ID NO: 15753 - RNA, 20 nt, Artificial Sequence
  Synthetic
uugaguauauaccauaugcc

SEQ ID NO: 15754 - RNA, 20 nt, Artificial Sequence
  Synthetic
ucacugcaaacucugccucc

SEQ ID NO: 15755 - RNA, 20 nt, Artificial Sequence
  Synthetic
ucacugcaaacuucgucucc

SEQ ID NO: 15756 - RNA, 20 nt, Artificial Sequence
  Synthetic
aucucagucuccugaguagc

SEQ ID NO: 15757 - RNA, 20 nt, Artificial Sequence
  Synthetic
acacuuugggaggccaaggc

SEQ ID NO: 15758 - RNA, 20 nt, Artificial Sequence
  Synthetic
ucucgcugugucacccaggc

SEQ ID NO: 15759 - RNA, 20 nt, Artificial Sequence
  Synthetic
ucuugcucuguugcccaggc

SEQ ID NO: 15760 - RNA, 20 nt, Artificial Sequence
  Synthetic
uuuugcuaugcuggccaggc

SEQ ID NO: 15761 - RNA, 20 nt, Artificial Sequence
  Synthetic
uuucgccauguuggccaggc

SEQ ID NO: 15762 - RNA, 20 nt, Artificial Sequence
  Synthetic
acucuaaaggaguaauaggc

SEQ ID NO: 15763 - RNA, 20 nt, Artificial Sequence
  Synthetic
accuuggccucccaaaaugc

SEQ ID NO: 15764 - RNA, 20 nt, Artificial Sequence
  Synthetic
ugguggcauuugccuuaugc

SEQ ID NO: 15765 - RNA, 20 nt, Artificial Sequence
  Synthetic
ucacccuuuuaucuggcauc

SEQ ID NO: 15766 - RNA, 20 nt, Artificial Sequence
  Synthetic
ccuucacucacccuuuuauc

SEQ ID NO: 15767 - RNA, 20 nt, Artificial Sequence
  Synthetic
cgggcagaucacuugagguc

SEQ ID NO: 15768 - RNA, 20 nt, Artificial Sequence
  Synthetic
ugggcagaucacuugagguc

SEQ ID NO: 15769 - RNA, 20 nt, Artificial Sequence
  Synthetic
caugguggaaaccauacuuc

SEQ ID NO: 15770 - RNA, 20 nt, Artificial Sequence
  Synthetic
aaaccaaauguguauuuuuc

SEQ ID NO: 15771 - RNA, 20 nt, Artificial Sequence
  Synthetic
agaugggaaagccaaggaag

SEQ ID NO: 15772 - RNA, 20 nt, Artificial Sequence
  Synthetic
agauaaaagggugagugaag

SEQ ID NO: 15773 - RNA, 20 nt, Artificial Sequence
  Synthetic
uguaaacccagcuacucgag

SEQ ID NO: 15774 - RNA, 20 nt, Artificial Sequence
  Synthetic
auauucaaagcugggcauag

SEQ ID NO: 15775 - RNA, 20 nt, Artificial Sequence
  Synthetic
ucacccaggcuggaguguag

SEQ ID NO: 15776 - RNA, 20 nt, Artificial Sequence
  Synthetic
ucccaaaguguugggauuag

SEQ ID NO: 15777 - RNA, 20 nt, Artificial Sequence
  Synthetic
acaaagggcuccuucuuucg

SEQ ID NO: 15778 - RNA, 20 nt, Artificial Sequence
  Synthetic
cucugugugugagagaaagg

SEQ ID NO: 15779 - RNA, 20 nt, Artificial Sequence
  Synthetic
aacacuuugggaggccaagg

SEQ ID NO: 15780 - RNA, 20 nt, Artificial Sequence
  Synthetic
agcauuuugggaggccaagg

SEQ ID NO: 15781 - RNA, 20 nt, Artificial Sequence
  Synthetic
uaagaaaagaaguaacaggg

SEQ ID NO: 15782 - RNA, 20 nt, Artificial Sequence
  Synthetic
agguggagaagcaugugggg

SEQ ID NO: 15783 - RNA, 20 nt, Artificial Sequence
  Synthetic
acuaaucccaacacuuuggg

SEQ ID NO: 15784 - RNA, 20 nt, Artificial Sequence
  Synthetic
uauaaucccagcauuuuggg

SEQ ID NO: 15785 - RNA, 20 nt, Artificial Sequence
  Synthetic
caaaaauuagccaggccugg

SEQ ID NO: 15786 - RNA, 20 nt, Artificial Sequence
  Synthetic
augaaagaaaaaauagaaug

SEQ ID NO: 15787 - RNA, 20 nt, Artificial Sequence
  Synthetic
uggugugugcaaaugccaug

SEQ ID NO: 15788 - RNA, 20 nt, Artificial Sequence
  Synthetic
uuuuuguauuuuaguagaug

SEQ ID NO: 15789 - RNA, 20 nt, Artificial Sequence
  Synthetic
uuuuacagaaaagcaaacug

SEQ ID NO: 15790 - RNA, 20 nt, Artificial Sequence
  Synthetic
cccagcuacucgagaggcug

SEQ ID NO: 15791 - RNA, 20 nt, Artificial Sequence
  Synthetic
caaaaauuagccaggcauug

SEQ ID NO: 15792 - RNA, 20 nt, Artificial Sequence
  Synthetic
caaggcgggcagaucacuug

SEQ ID NO: 15793 - RNA, 20 nt, Artificial Sequence
  Synthetic
caaggugggcagaucacuug

SEQ ID NO: 15794 - RNA, 20 nt, Artificial Sequence
  Synthetic
uacuucuuuucuuauaaaau

SEQ ID NO: 15795 - RNA, 20 nt, Artificial Sequence
  Synthetic
uuguugaauugaaguaaaau

SEQ ID NO: 15796 - RNA, 20 nt, Artificial Sequence
  Synthetic
uaugaaagaaaaaauagaau

SEQ ID NO: 15797 - RNA, 20 nt, Artificial Sequence
  Synthetic
uauccccaagugccuagaau

SEQ ID NO: 15798 - RNA, 20 nt, Artificial Sequence
  Synthetic
uugaauaucuaaguuuuaau

SEQ ID NO: 15799 - RNA, 20 nt, Artificial Sequence
  Synthetic
uuuuuaaauugaaucaacau

SEQ ID NO: 15800 - RNA, 20 nt, Artificial Sequence
  Synthetic
uguuuucuuuuaaauacuau

SEQ ID NO: 15801 - RNA, 20 nt, Artificial Sequence
  Synthetic
ucccaaaaugcugggauuau

SEQ ID NO: 15802 - RNA, 20 nt, Artificial Sequence
  Synthetic
uuuuguuuuuuauuuuuuau

SEQ ID NO: 15803 - RNA, 20 nt, Artificial Sequence
  Synthetic
caggcccuauucuaggcacu

SEQ ID NO: 15804 - RNA, 20 nt, Artificial Sequence
  Synthetic
cucaagugaucugcccaccu

SEQ ID NO: 15805 - RNA, 20 nt, Artificial Sequence
  Synthetic
acuuuguaccucugcacccu

SEQ ID NO: 15806 - RNA, 20 nt, Artificial Sequence
  Synthetic
acaccacuacacuccagccu

SEQ ID NO: 15807 - RNA, 20 nt, Artificial Sequence
  Synthetic
cucaagugaucugcccgccu

SEQ ID NO: 15808 - RNA, 20 nt, Artificial Sequence
  Synthetic
cacugcaaacucugccuccu

SEQ ID NO: 15809 - RNA, 20 nt, Artificial Sequence
  Synthetic
cacugcaaacuucgucuccu

SEQ ID NO: 15810 - RNA, 20 nt, Artificial Sequence
  Synthetic
ccucagccucucgaguagcu

SEQ ID NO: 15811 - RNA, 20 nt, Artificial Sequence
  Synthetic
ucucagucuccugaguagcu

SEQ ID NO: 15812 - RNA, 20 nt, Artificial Sequence
  Synthetic
ccuuggccucccaaaaugcu

SEQ ID NO: 15813 - RNA, 20 nt, Artificial Sequence
  Synthetic
cauaugccaggcccuauucu

SEQ ID NO: 15814 - RNA, 20 nt, Artificial Sequence
  Synthetic
uuuacuuaagcuaguaaauu

SEQ ID NO: 15815 - RNA, 20 nt, Artificial Sequence
  Synthetic
uuuccugaaaaauacacauu

SEQ ID NO: 15816 - RNA, 20 nt, Artificial Sequence
  Synthetic
uuuguuuuuuauuuuuuauu

SEQ ID NO: 15817 - RNA, 20 nt, Artificial Sequence
  Synthetic
cgccacuaaucccaacacuu

SEQ ID NO: 15818 - RNA, 20 nt, Artificial Sequence
  Synthetic
aggcccuauucuaggcacuu

SEQ ID NO: 15819 - RNA, 20 nt, Artificial Sequence
  Synthetic
ccuuggccucccaaaguguu

SEQ ID NO: 15820 - RNA, 20 nt, Artificial Sequence
  Synthetic
caccuauaaucccagcauuu

SEQ ID NO: 15821 - RNA, 20 nt, Artificial Sequence
  Synthetic
ugaaauuuauugaaauauuu

SEQ ID NO: 15822 - RNA, 20 nt, Artificial Sequence
  Synthetic
accuauaaucccagcauuuu

SEQ ID NO: 15823 - RNA, 20 nt, Artificial Sequence
  Synthetic
uuaaauucauuuccuuuuuu

SEQ ID NO: 15824 - RNA, 20 nt, Artificial Sequence
  Synthetic
guuagcuaugaaagaaaaaa

SEQ ID NO: 15825 - RNA, 19 nt, Artificial Sequence
  Synthetic
guguacauaaaccaacaaa

SEQ ID NO: 15826 - RNA, 21 nt, Artificial Sequence
  Synthetic
guguguacauaaaccaacaaa

SEQ ID NO: 15827 - RNA, 22 nt, Artificial Sequence
  Synthetic
gguguguacauaaaccaacaaa

SEQ ID NO: 15828 - RNA, 23 nt, Artificial Sequence
  Synthetic
ggguguguacauaaaccaacaaa

SEQ ID NO: 15829 - RNA, 24 nt, Artificial Sequence
  Synthetic
gggguguguacauaaaccaacaaa

SEQ ID NO: 15830 - RNA, 19 nt, Artificial Sequence
  Synthetic
gccuuuuuucucuucacaa

SEQ ID NO: 15831 - RNA, 23 nt, Artificial Sequence
  Synthetic
gaaagccuuuuuucucuucacaa

SEQ ID NO: 15832 - RNA, 18 nt, Artificial Sequence
  Synthetic
ggcucuaaaucacucuaa

SEQ ID NO: 15833 - RNA, 21 nt, Artificial Sequence
  Synthetic
gcauuugaguccuugguccca

SEQ ID NO: 15834 - RNA, 22 nt, Artificial Sequence
  Synthetic
ggcauuugaguccuugguccca

SEQ ID NO: 15835 - RNA, 24 nt, Artificial Sequence
  Synthetic
guggcauuugaguccuugguccca

SEQ ID NO: 15836 - RNA, 22 nt, Artificial Sequence
  Synthetic
gccauuaccuuaagacuuccca

SEQ ID NO: 15837 - RNA, 20 nt, Artificial Sequence
  Synthetic
guagagagaccaggagagca

SEQ ID NO: 15838 - RNA, 19 nt, Artificial Sequence
  Synthetic
guccuuaaagauaggagca

SEQ ID NO: 15839 - RNA, 20 nt, Artificial Sequence
  Synthetic
gguccuuaaagauaggagca

SEQ ID NO: 15840 - RNA, 22 nt, Artificial Sequence
  Synthetic
gugguccuuaaagauaggagca

SEQ ID NO: 15841 - RNA, 21 nt, Artificial Sequence
  Synthetic
gaacuugucaauauaccugca

SEQ ID NO: 15842 - RNA, 18 nt, Artificial Sequence
  Synthetic
gcacacugcaguuaugua

SEQ ID NO: 15843 - RNA, 22 nt, Artificial Sequence
  Synthetic
guuugcacacugcaguuaugua

SEQ ID NO: 15844 - RNA, 23 nt, Artificial Sequence
  Synthetic
gguuugcacacugcaguuaugua

SEQ ID NO: 15845 - RNA, 18 nt, Artificial Sequence
  Synthetic
ggucggggaauuucuuua

SEQ ID NO: 15846 - RNA, 22 nt, Artificial Sequence
  Synthetic
gcaaggucggggaauuucuuua

SEQ ID NO: 15847 - RNA, 23 nt, Artificial Sequence
  Synthetic
ggcaaggucggggaauuucuuua

SEQ ID NO: 15848 - RNA, 19 nt, Artificial Sequence
  Synthetic
gccacaaauuguuagcacc

SEQ ID NO: 15849 - RNA, 21 nt, Artificial Sequence
  Synthetic
gugccacaaauuguuagcacc

SEQ ID NO: 15850 - RNA, 22 nt, Artificial Sequence
  Synthetic
ggugccacaaauuguuagcacc

SEQ ID NO: 15851 - RNA, 19 nt, Artificial Sequence
  Synthetic
gaagccagggucacuuccc

SEQ ID NO: 15852 - RNA, 21 nt, Artificial Sequence
  Synthetic
gugaagccagggucacuuccc

SEQ ID NO: 15853 - RNA, 20 nt, Artificial Sequence
  Synthetic
gcaguuaugaaaugugaagc

SEQ ID NO: 15854 - RNA, 21 nt, Artificial Sequence
  Synthetic
ggcaguuaugaaaugugaagc

SEQ ID NO: 15855 - RNA, 18 nt, Artificial Sequence
  Synthetic
gccuggcaaucucuaagc

SEQ ID NO: 15856 - RNA, 23 nt, Artificial Sequence
  Synthetic
gacaagccuggcaaucucuaagc

SEQ ID NO: 15857 - RNA, 18 nt, Artificial Sequence
  Synthetic
ggcaauacagaccucagc

SEQ ID NO: 15858 - RNA, 22 nt, Artificial Sequence
  Synthetic
gcaaggcaauacagaccucagc

SEQ ID NO: 15859 - RNA, 24 nt, Artificial Sequence
  Synthetic
gagcaaggcaauacagaccucagc

SEQ ID NO: 15860 - RNA, 18 nt, Artificial Sequence
  Synthetic
gccauuucacauuccauc

SEQ ID NO: 15861 - RNA, 22 nt, Artificial Sequence
  Synthetic
gcuagccauuucacauuccauc

SEQ ID NO: 15862 - RNA, 18 nt, Artificial Sequence
  Synthetic
ggguaagcacuaugacuc

SEQ ID NO: 15863 - RNA, 19 nt, Artificial Sequence
  Synthetic
gggguaagcacuaugacuc

SEQ ID NO: 15864 - RNA, 21 nt, Artificial Sequence
  Synthetic
gcacuaugacucaagagucuc

SEQ ID NO: 15865 - RNA, 18 nt, Artificial Sequence
  Synthetic
gaggagaaggcaaggucg

SEQ ID NO: 15866 - RNA, 21 nt, Artificial Sequence
  Synthetic
guuuguacuggcauagcauug

SEQ ID NO: 15867 - RNA, 22 nt, Artificial Sequence
  Synthetic
gguuuguacuggcauagcauug

SEQ ID NO: 15868 - RNA, 23 nt, Artificial Sequence
  Synthetic
ggguuuguacuggcauagcauug

SEQ ID NO: 15869 - RNA, 21 nt, Artificial Sequence
  Synthetic
gcaaaugccaccagguggcau

SEQ ID NO: 15870 - RNA, 22 nt, Artificial Sequence
  Synthetic
ggcaaaugccaccagguggcau

SEQ ID NO: 15871 - RNA, 19 nt, Artificial Sequence
  Synthetic
gauaaugaugcuuuccacu

SEQ ID NO: 15872 - RNA, 19 nt, Artificial Sequence
  Synthetic
gccuaguucauucuagacu

SEQ ID NO: 15873 - RNA, 23 nt, Artificial Sequence
  Synthetic
gcuacucccacuagcuuaauucu

SEQ ID NO: 15874 - RNA, 18 nt, Artificial Sequence
  Synthetic
gcccuugaucuuagaagu

SEQ ID NO: 15875 - RNA, 19 nt, Artificial Sequence
  Synthetic
ggcccuugaucuuagaagu

SEQ ID NO: 15876 - RNA, 22 nt, Artificial Sequence
  Synthetic
gcuggcccuugaucuuagaagu

SEQ ID NO: 15877 - RNA, 19 nt, Artificial Sequence
  Synthetic
gaccagcuuucuacauaaa

SEQ ID NO: 15878 - RNA, 20 nt, Artificial Sequence
  Synthetic
ggaccagcuuucuacauaaa

SEQ ID NO: 15879 - RNA, 24 nt, Artificial Sequence
  Synthetic
gaccggaccagcuuucuacauaaa

SEQ ID NO: 15880 - RNA, 22 nt, Artificial Sequence
  Synthetic
gcacaggccugaugccagauaa

SEQ ID NO: 15881 - RNA, 22 nt, Artificial Sequence
  Synthetic
gcuuugaauaucuaaguuuuaa

SEQ ID NO: 15882 - RNA, 22 nt, Artificial Sequence
  Synthetic
gaaaaauacacauuugguuuca

SEQ ID NO: 15883 - RNA, 19 nt, Artificial Sequence
  Synthetic
gcuuaaguaaauaaaagga

SEQ ID NO: 15884 - RNA, 21 nt, Artificial Sequence
  Synthetic
gcucaauuuugugaccaugga

SEQ ID NO: 15885 - RNA, 22 nt, Artificial Sequence
  Synthetic
ggcucaauuuugugaccaugga

SEQ ID NO: 15886 - RNA, 18 nt, Artificial Sequence
  Synthetic
guuuuaauuggaugcuga

SEQ ID NO: 15887 - RNA, 20 nt, Artificial Sequence
  Synthetic
gaaugguagucccccccaua

SEQ ID NO: 15888 - RNA, 21 nt, Artificial Sequence
  Synthetic
ggaaugguagucccccccaua

SEQ ID NO: 15889 - RNA, 20 nt, Artificial Sequence
  Synthetic
gacaaguucaaaauaauaua

SEQ ID NO: 15890 - RNA, 21 nt, Artificial Sequence
  Synthetic
gcucucauuagcaagcuucua

SEQ ID NO: 15891 - RNA, 22 nt, Artificial Sequence
  Synthetic
ggcucucauuagcaagcuucua

SEQ ID NO: 15892 - RNA, 23 nt, Artificial Sequence
  Synthetic
gggcucucauuagcaagcuucua

SEQ ID NO: 15893 - RNA, 22 nt, Artificial Sequence
  Synthetic
guucaaaauaauauaaugggua

SEQ ID NO: 15894 - RNA, 21 nt, Artificial Sequence
  Synthetic
gauaauauacuuugccaguua

SEQ ID NO: 15895 - RNA, 23 nt, Artificial Sequence
  Synthetic
gagauaauauacuuugccaguua

SEQ ID NO: 15896 - RNA, 23 nt, Artificial Sequence
  Synthetic
guauuuauggccagauagagaac

SEQ ID NO: 15897 - RNA, 18 nt, Artificial Sequence
  Synthetic
gauguauccccaagugcc

SEQ ID NO: 15898 - RNA, 20 nt, Artificial Sequence
  Synthetic
guuccuaaaacuacauugcc

SEQ ID NO: 15899 - RNA, 18 nt, Artificial Sequence
  Synthetic
gaaaaaucccagagacuc

SEQ ID NO: 15900 - RNA, 20 nt, Artificial Sequence
  Synthetic
gugaaaaaucccagagacuc

SEQ ID NO: 15901 - RNA, 23 nt, Artificial Sequence
  Synthetic
gccagauaaaagggugagugaag

SEQ ID NO: 15902 - RNA, 20 nt, Artificial Sequence
  Synthetic
gucuuauuagagaccaugag

SEQ ID NO: 15903 - RNA, 20 nt, Artificial Sequence
  Synthetic
gccugaugccagauaaaagg

SEQ ID NO: 15904 - RNA, 19 nt, Artificial Sequence
  Synthetic
guaccuguuacaugccagg

SEQ ID NO: 15905 - RNA, 21 nt, Artificial Sequence
  Synthetic
gaguaccuguuacaugccagg

SEQ ID NO: 15906 - RNA, 21 nt, Artificial Sequence
  Synthetic
gaaugauuaaucagaguaggg

SEQ ID NO: 15907 - RNA, 22 nt, Artificial Sequence
  Synthetic
ggaaugauuaaucagaguaggg

SEQ ID NO: 15908 - RNA, 23 nt, Artificial Sequence
  Synthetic
gggaaugauuaaucagaguaggg

SEQ ID NO: 15909 - RNA, 19 nt, Artificial Sequence
  Synthetic
gaacaugaaucugaauuug

SEQ ID NO: 15910 - RNA, 20 nt, Artificial Sequence
  Synthetic
gccagauagagaacaugaau

SEQ ID NO: 15911 - RNA, 21 nt, Artificial Sequence
  Synthetic
gaugcugagggaaugauuaau

SEQ ID NO: 15912 - RNA, 22 nt, Artificial Sequence
  Synthetic
ggaugcugagggaaugauuaau

SEQ ID NO: 15913 - RNA, 19 nt, Artificial Sequence
  Synthetic
gcuuucaaaaccuuuauau

SEQ ID NO: 15914 - RNA, 21 nt, Artificial Sequence
  Synthetic
gaauaucuccucucagccacu

SEQ ID NO: 15915 - RNA, 24 nt, Artificial Sequence
  Synthetic
guagaauaucuccucucagccacu

SEQ ID NO: 15916 - RNA, 22 nt, Artificial Sequence
  Synthetic
gcuccauauuuagcuucuuacu

SEQ ID NO: 15917 - RNA, 21 nt, Artificial Sequence
  Synthetic
gucuguauugccuugcucucu

SEQ ID NO: 15918 - RNA, 22 nt, Artificial Sequence
  Synthetic
ggucuguauugccuugcucucu

SEQ ID NO: 15919 - RNA, 24 nt, Artificial Sequence
  Synthetic
gaggucuguauugccuugcucucu

SEQ ID NO: 15920 - RNA, 22 nt, Artificial Sequence
  Synthetic
guuuccuuuccaaucaaaaggu

SEQ ID NO: 15921 - RNA, 20 nt, Artificial Sequence
  Synthetic
gccccggccuauuacuccuu

SEQ ID NO: 15922 - RNA, 19 nt, Artificial Sequence
  Synthetic
gucaggauaugaacuuuuu

SEQ ID NO: 15923 - RNA, 22 nt, Artificial Sequence
  Synthetic
guagucaggauaugaacuuuuu

SEQ ID NO: 15924 - RNA, 18 nt, Artificial Sequence
  Synthetic
uagcuaugaaagaaaaaa

SEQ ID NO: 15925 - RNA, 19 nt, Artificial Sequence
  Synthetic
uuagcuaugaaagaaaaaa

SEQ ID NO: 15926 - RNA, 18 nt, Artificial Sequence
  Synthetic
uguacauaaaccaacaaa

SEQ ID NO: 15927 - RNA, 20 nt, Artificial Sequence
  Synthetic
uguguacauaaaccaacaaa

SEQ ID NO: 15928 - RNA, 21 nt, Artificial Sequence
  Synthetic
uuauuuacuuaagcuaguaaa

SEQ ID NO: 15929 - RNA, 22 nt, Artificial Sequence
  Synthetic
uuuauuuacuuaagcuaguaaa

SEQ ID NO: 15930 - RNA, 23 nt, Artificial Sequence
  Synthetic
uuuuauuuacuuaagcuaguaaa

SEQ ID NO: 15931 - RNA, 24 nt, Artificial Sequence
  Synthetic
cuuuuauuuacuuaagcuaguaaa

SEQ ID NO: 15932 - RNA, 18 nt, Artificial Sequence
  Synthetic
ccuuuuuucucuucacaa

SEQ ID NO: 15933 - RNA, 21 nt, Artificial Sequence
  Synthetic
aagccuuuuuucucuucacaa

SEQ ID NO: 15934 - RNA, 22 nt, Artificial Sequence
  Synthetic
aaagccuuuuuucucuucacaa

SEQ ID NO: 15935 - RNA, 24 nt, Artificial Sequence
  Synthetic
ugaaagccuuuuuucucuucacaa

SEQ ID NO: 15936 - RNA, 21 nt, Artificial Sequence
  Synthetic
accuucuccaucaaaggagaa

SEQ ID NO: 15937 - RNA, 22 nt, Artificial Sequence
  Synthetic
caccuucuccaucaaaggagaa

SEQ ID NO: 15938 - RNA, 23 nt, Artificial Sequence
  Synthetic
ucaccuucuccaucaaaggagaa

SEQ ID NO: 15939 - RNA, 24 nt, Artificial Sequence
  Synthetic
cucaccuucuccaucaaaggagaa

SEQ ID NO: 15940 - RNA, 19 nt, Artificial Sequence
  Synthetic
uggcucuaaaucacucuaa

SEQ ID NO: 15941 - RNA, 21 nt, Artificial Sequence
  Synthetic
cauggcucuaaaucacucuaa

SEQ ID NO: 15942 - RNA, 22 nt, Artificial Sequence
  Synthetic
acauggcucuaaaucacucuaa

SEQ ID NO: 15943 - RNA, 23 nt, Artificial Sequence
  Synthetic
aacauggcucuaaaucacucuaa

SEQ ID NO: 15944 - RNA, 24 nt, Artificial Sequence
  Synthetic
aaacauggcucuaaaucacucuaa

SEQ ID NO: 15945 - RNA, 18 nt, Artificial Sequence
  Synthetic
uagacuaugaguggccca

SEQ ID NO: 15946 - RNA, 19 nt, Artificial Sequence
  Synthetic
cuagacuaugaguggccca

SEQ ID NO: 15947 - RNA, 21 nt, Artificial Sequence
  Synthetic
uucuagacuaugaguggccca

SEQ ID NO: 15948 - RNA, 22 nt, Artificial Sequence
  Synthetic
auucuagacuaugaguggccca

SEQ ID NO: 15949 - RNA, 23 nt, Artificial Sequence
  Synthetic
cauucuagacuaugaguggccca

SEQ ID NO: 15950 - RNA, 24 nt, Artificial Sequence
  Synthetic
ucauucuagacuaugaguggccca

SEQ ID NO: 15951 - RNA, 18 nt, Artificial Sequence
  Synthetic
uuugaguccuugguccca

SEQ ID NO: 15952 - RNA, 19 nt, Artificial Sequence
  Synthetic
auuugaguccuugguccca

SEQ ID NO: 15953 - RNA, 20 nt, Artificial Sequence
  Synthetic
cauuugaguccuugguccca

SEQ ID NO: 15954 - RNA, 23 nt, Artificial Sequence
  Synthetic
uggcauuugaguccuugguccca

SEQ ID NO: 15955 - RNA, 18 nt, Artificial Sequence
  Synthetic
uuaccuuaagacuuccca

SEQ ID NO: 15956 - RNA, 19 nt, Artificial Sequence
  Synthetic
auuaccuuaagacuuccca

SEQ ID NO: 15957 - RNA, 21 nt, Artificial Sequence
  Synthetic
ccauuaccuuaagacuuccca

SEQ ID NO: 15958 - RNA, 23 nt, Artificial Sequence
  Synthetic
agccauuaccuuaagacuuccca

SEQ ID NO: 15959 - RNA, 24 nt, Artificial Sequence
  Synthetic
uagccauuaccuuaagacuuccca

SEQ ID NO: 15960 - RNA, 18 nt, Artificial Sequence
  Synthetic
agagagaccaggagagca

SEQ ID NO: 15961 - RNA, 19 nt, Artificial Sequence
  Synthetic
uagagagaccaggagagca

SEQ ID NO: 15962 - RNA, 18 nt, Artificial Sequence
  Synthetic
uccuuaaagauaggagca

SEQ ID NO: 15963 - RNA, 21 nt, Artificial Sequence
  Synthetic
ugguccuuaaagauaggagca

SEQ ID NO: 15964 - RNA, 23 nt, Artificial Sequence
  Synthetic
cgugguccuuaaagauaggagca

SEQ ID NO: 15965 - RNA, 24 nt, Artificial Sequence
  Synthetic
ucgugguccuuaaagauaggagca

SEQ ID NO: 15966 - RNA, 18 nt, Artificial Sequence
  Synthetic
cuugucaauauaccugca

SEQ ID NO: 15967 - RNA, 19 nt, Artificial Sequence
  Synthetic
acuugucaauauaccugca

SEQ ID NO: 15968 - RNA, 20 nt, Artificial Sequence
  Synthetic
aacuugucaauauaccugca

SEQ ID NO: 15969 - RNA, 22 nt, Artificial Sequence
  Synthetic
ugaacuugucaauauaccugca

SEQ ID NO: 15970 - RNA, 23 nt, Artificial Sequence
  Synthetic
uugaacuugucaauauaccugca

SEQ ID NO: 15971 - RNA, 24 nt, Artificial Sequence
  Synthetic
uuugaacuugucaauauaccugca

SEQ ID NO: 15972 - RNA, 18 nt, Artificial Sequence
  Synthetic
agaugggaaagccaagga

SEQ ID NO: 15973 - RNA, 19 nt, Artificial Sequence
  Synthetic
cagaugggaaagccaagga

SEQ ID NO: 15974 - RNA, 18 nt, Artificial Sequence
  Synthetic
ccugacuacaaucuugga

SEQ ID NO: 15975 - RNA, 19 nt, Artificial Sequence
  Synthetic
uccugacuacaaucuugga

SEQ ID NO: 15976 - RNA, 20 nt, Artificial Sequence
  Synthetic
auccugacuacaaucuugga

SEQ ID NO: 15977 - RNA, 21 nt, Artificial Sequence
  Synthetic
uauccugacuacaaucuugga

SEQ ID NO: 15978 - RNA, 22 nt, Artificial Sequence
  Synthetic
auauccugacuacaaucuugga

SEQ ID NO: 15979 - RNA, 23 nt, Artificial Sequence
  Synthetic
cauauccugacuacaaucuugga

SEQ ID NO: 15980 - RNA, 24 nt, Artificial Sequence
  Synthetic
ucauauccugacuacaaucuugga

SEQ ID NO: 15981 - RNA, 19 nt, Artificial Sequence
  Synthetic
ugcacacugcaguuaugua

SEQ ID NO: 15982 - RNA, 20 nt, Artificial Sequence
  Synthetic
uugcacacugcaguuaugua

SEQ ID NO: 15983 - RNA, 21 nt, Artificial Sequence
  Synthetic
uuugcacacugcaguuaugua

SEQ ID NO: 15984 - RNA, 24 nt, Artificial Sequence
  Synthetic
ugguuugcacacugcaguuaugua

SEQ ID NO: 15985 - RNA, 19 nt, Artificial Sequence
  Synthetic
aggucggggaauuucuuua

SEQ ID NO: 15986 - RNA, 20 nt, Artificial Sequence
  Synthetic
aaggucggggaauuucuuua

SEQ ID NO: 15987 - RNA, 21 nt, Artificial Sequence
  Synthetic
caaggucggggaauuucuuua

SEQ ID NO: 15988 - RNA, 24 nt, Artificial Sequence
  Synthetic
aggcaaggucggggaauuucuuua

SEQ ID NO: 15989 - RNA, 18 nt, Artificial Sequence
  Synthetic
ccacaaauuguuagcacc

SEQ ID NO: 15990 - RNA, 20 nt, Artificial Sequence
  Synthetic
ugccacaaauuguuagcacc

SEQ ID NO: 15991 - RNA, 23 nt, Artificial Sequence
  Synthetic
uggugccacaaauuguuagcacc

SEQ ID NO: 15992 - RNA, 24 nt, Artificial Sequence
  Synthetic
uuggugccacaaauuguuagcacc

SEQ ID NO: 15993 - RNA, 18 nt, Artificial Sequence
  Synthetic
aagccagggucacuuccc

SEQ ID NO: 15994 - RNA, 20 nt, Artificial Sequence
  Synthetic
ugaagccagggucacuuccc

SEQ ID NO: 15995 - RNA, 22 nt, Artificial Sequence
  Synthetic
ugugaagccagggucacuuccc

SEQ ID NO: 15996 - RNA, 23 nt, Artificial Sequence
  Synthetic
augugaagccagggucacuuccc

SEQ ID NO: 15997 - RNA, 24 nt, Artificial Sequence
  Synthetic
aaugugaagccagggucacuuccc

SEQ ID NO: 15998 - RNA, 18 nt, Artificial Sequence
  Synthetic
aguuaugaaaugugaagc

SEQ ID NO: 15999 - RNA, 19 nt, Artificial Sequence
  Synthetic
caguuaugaaaugugaagc

SEQ ID NO: 16000 - RNA, 22 nt, Artificial Sequence
  Synthetic
aggcaguuaugaaaugugaagc

SEQ ID NO: 16001 - RNA, 23 nt, Artificial Sequence
  Synthetic
aaggcaguuaugaaaugugaagc

SEQ ID NO: 16002 - RNA, 24 nt, Artificial Sequence
  Synthetic
caaggcaguuaugaaaugugaagc

SEQ ID NO: 16003 - RNA, 19 nt, Artificial Sequence
  Synthetic
agccuggcaaucucuaagc

SEQ ID NO: 16004 - RNA, 20 nt, Artificial Sequence
  Synthetic
aagccuggcaaucucuaagc

SEQ ID NO: 16005 - RNA, 21 nt, Artificial Sequence
  Synthetic
caagccuggcaaucucuaagc

SEQ ID NO: 16006 - RNA, 22 nt, Artificial Sequence
  Synthetic
acaagccuggcaaucucuaagc

SEQ ID NO: 16007 - RNA, 24 nt, Artificial Sequence
  Synthetic
agacaagccuggcaaucucuaagc

SEQ ID NO: 16008 - RNA, 19 nt, Artificial Sequence
  Synthetic
aggcaauacagaccucagc

SEQ ID NO: 16009 - RNA, 21 nt, Artificial Sequence
  Synthetic
caaggcaauacagaccucagc

SEQ ID NO: 16010 - RNA, 23 nt, Artificial Sequence
  Synthetic
agcaaggcaauacagaccucagc

SEQ ID NO: 16011 - RNA, 19 nt, Artificial Sequence
  Synthetic
agccauuucacauuccauc

SEQ ID NO: 16012 - RNA, 20 nt, Artificial Sequence
  Synthetic
uagccauuucacauuccauc

SEQ ID NO: 16013 - RNA, 21 nt, Artificial Sequence
  Synthetic
cuagccauuucacauuccauc

SEQ ID NO: 16014 - RNA, 23 nt, Artificial Sequence
  Synthetic
ugcuagccauuucacauuccauc

SEQ ID NO: 16015 - RNA, 24 nt, Artificial Sequence
  Synthetic
augcuagccauuucacauuccauc

SEQ ID NO: 16016 - RNA, 20 nt, Artificial Sequence
  Synthetic
agggguaagcacuaugacuc

SEQ ID NO: 16017 - RNA, 21 nt, Artificial Sequence
  Synthetic
aagggguaagcacuaugacuc

SEQ ID NO: 16018 - RNA, 22 nt, Artificial Sequence
  Synthetic
caagggguaagcacuaugacuc

SEQ ID NO: 16019 - RNA, 23 nt, Artificial Sequence
  Synthetic
ccaagggguaagcacuaugacuc

SEQ ID NO: 16020 - RNA, 24 nt, Artificial Sequence
  Synthetic
cccaagggguaagcacuaugacuc

SEQ ID NO: 16021 - RNA, 18 nt, Artificial Sequence
  Synthetic
cuaugacucaagagucuc

SEQ ID NO: 16022 - RNA, 19 nt, Artificial Sequence
  Synthetic
acuaugacucaagagucuc

SEQ ID NO: 16023 - RNA, 22 nt, Artificial Sequence
  Synthetic
agcacuaugacucaagagucuc

SEQ ID NO: 16024 - RNA, 23 nt, Artificial Sequence
  Synthetic
aagcacuaugacucaagagucuc

SEQ ID NO: 16025 - RNA, 24 nt, Artificial Sequence
  Synthetic
uaagcacuaugacucaagagucuc

SEQ ID NO: 16026 - RNA, 19 nt, Artificial Sequence
  Synthetic
ugaggagaaggcaaggucg

SEQ ID NO: 16027 - RNA, 18 nt, Artificial Sequence
  Synthetic
uuaaauugaaucaacaug

SEQ ID NO: 16028 - RNA, 19 nt, Artificial Sequence
  Synthetic
uuuaaauugaaucaacaug

SEQ ID NO: 16029 - RNA, 18 nt, Artificial Sequence
  Synthetic
uguacuggcauagcauug

SEQ ID NO: 16030 - RNA, 19 nt, Artificial Sequence
  Synthetic
uuguacuggcauagcauug

SEQ ID NO: 16031 - RNA, 20 nt, Artificial Sequence
  Synthetic
uuuguacuggcauagcauug

SEQ ID NO: 16032 - RNA, 24 nt, Artificial Sequence
  Synthetic
uggguuuguacuggcauagcauug

SEQ ID NO: 16033 - RNA, 23 nt, Artificial Sequence
  Synthetic
aggcaaaugccaccagguggcau

SEQ ID NO: 16034 - RNA, 24 nt, Artificial Sequence
  Synthetic
aaggcaaaugccaccagguggcau

SEQ ID NO: 16035 - RNA, 18 nt, Artificial Sequence
  Synthetic
auaaugaugcuuuccacu

SEQ ID NO: 16036 - RNA, 20 nt, Artificial Sequence
  Synthetic
agauaaugaugcuuuccacu

SEQ ID NO: 16037 - RNA, 18 nt, Artificial Sequence
  Synthetic
ccuaguucauucuagacu

SEQ ID NO: 16038 - RNA, 20 nt, Artificial Sequence
  Synthetic
agccuaguucauucuagacu

SEQ ID NO: 16039 - RNA, 21 nt, Artificial Sequence
  Synthetic
cagccuaguucauucuagacu

SEQ ID NO: 16040 - RNA, 22 nt, Artificial Sequence
  Synthetic
ucagccuaguucauucuagacu

SEQ ID NO: 16041 - RNA, 23 nt, Artificial Sequence
  Synthetic
cucagccuaguucauucuagacu

SEQ ID NO: 16042 - RNA, 24 nt, Artificial Sequence
  Synthetic
acucagccuaguucauucuagacu

SEQ ID NO: 16043 - RNA, 18 nt, Artificial Sequence
  Synthetic
ccauaacauuugguuacu

SEQ ID NO: 16044 - RNA, 19 nt, Artificial Sequence
  Synthetic
uccauaacauuugguuacu

SEQ ID NO: 16045 - RNA, 20 nt, Artificial Sequence
  Synthetic
auccauaacauuugguuacu

SEQ ID NO: 16046 - RNA, 21 nt, Artificial Sequence
  Synthetic
cauccauaacauuugguuacu

SEQ ID NO: 16047 - RNA, 22 nt, Artificial Sequence
  Synthetic
ccauccauaacauuugguuacu

SEQ ID NO: 16048 - RNA, 23 nt, Artificial Sequence
  Synthetic
cccauccauaacauuugguuacu

SEQ ID NO: 16049 - RNA, 24 nt, Artificial Sequence
  Synthetic
ucccauccauaacauuugguuacu

SEQ ID NO: 16050 - RNA, 18 nt, Artificial Sequence
  Synthetic
ucccacuagcuuaauucu

SEQ ID NO: 16051 - RNA, 19 nt, Artificial Sequence
  Synthetic
cucccacuagcuuaauucu

SEQ ID NO: 16052 - RNA, 20 nt, Artificial Sequence
  Synthetic
acucccacuagcuuaauucu

SEQ ID NO: 16053 - RNA, 21 nt, Artificial Sequence
  Synthetic
uacucccacuagcuuaauucu

SEQ ID NO: 16054 - RNA, 22 nt, Artificial Sequence
  Synthetic
cuacucccacuagcuuaauucu

SEQ ID NO: 16055 - RNA, 24 nt, Artificial Sequence
  Synthetic
ugcuacucccacuagcuuaauucu

SEQ ID NO: 16056 - RNA, 20 nt, Artificial Sequence
  Synthetic
uggcccuugaucuuagaagu

SEQ ID NO: 16057 - RNA, 21 nt, Artificial Sequence
  Synthetic
cuggcccuugaucuuagaagu

SEQ ID NO: 16058 - RNA, 23 nt, Artificial Sequence
  Synthetic
agcuggcccuugaucuuagaagu

SEQ ID NO: 16059 - RNA, 24 nt, Artificial Sequence
  Synthetic
aagcuggcccuugaucuuagaagu

SEQ ID NO: 16060 - RNA, 18 nt, Artificial Sequence
  Synthetic
accagcuuucuacauaaa

SEQ ID NO: 16061 - RNA, 21 nt, Artificial Sequence
  Synthetic
cggaccagcuuucuacauaaa

SEQ ID NO: 16062 - RNA, 22 nt, Artificial Sequence
  Synthetic
ccggaccagcuuucuacauaaa

SEQ ID NO: 16063 - RNA, 23 nt, Artificial Sequence
  Synthetic
accggaccagcuuucuacauaaa

SEQ ID NO: 16064 - RNA, 18 nt, Artificial Sequence
  Synthetic
aggccugaugccagauaa

SEQ ID NO: 16065 - RNA, 19 nt, Artificial Sequence
  Synthetic
caggccugaugccagauaa

SEQ ID NO: 16066 - RNA, 20 nt, Artificial Sequence
  Synthetic
acaggccugaugccagauaa

SEQ ID NO: 16067 - RNA, 21 nt, Artificial Sequence
  Synthetic
cacaggccugaugccagauaa

SEQ ID NO: 16068 - RNA, 23 nt, Artificial Sequence
  Synthetic
agcacaggccugaugccagauaa

SEQ ID NO: 16069 - RNA, 24 nt, Artificial Sequence
  Synthetic
cagcacaggccugaugccagauaa

SEQ ID NO: 16070 - RNA, 21 nt, Artificial Sequence
  Synthetic
cuuugaauaucuaaguuuuaa

SEQ ID NO: 16071 - RNA, 23 nt, Artificial Sequence
  Synthetic
agcuuugaauaucuaaguuuuaa

SEQ ID NO: 16072 - RNA, 24 nt, Artificial Sequence
  Synthetic
cagcuuugaauaucuaaguuuuaa

SEQ ID NO: 16073 - RNA, 18 nt, Artificial Sequence
  Synthetic
ugcaccaaaguaaaaaca

SEQ ID NO: 16074 - RNA, 19 nt, Artificial Sequence
  Synthetic
uugcaccaaaguaaaaaca

SEQ ID NO: 16075 - RNA, 20 nt, Artificial Sequence
  Synthetic
auugcaccaaaguaaaaaca

SEQ ID NO: 16076 - RNA, 21 nt, Artificial Sequence
  Synthetic
uauugcaccaaaguaaaaaca

SEQ ID NO: 16077 - RNA, 22 nt, Artificial Sequence
  Synthetic
uuauugcaccaaaguaaaaaca

SEQ ID NO: 16078 - RNA, 23 nt, Artificial Sequence
  Synthetic
auuauugcaccaaaguaaaaaca

SEQ ID NO: 16079 - RNA, 24 nt, Artificial Sequence
  Synthetic
aauuauugcaccaaaguaaaaaca

SEQ ID NO: 16080 - RNA, 21 nt, Artificial Sequence
  Synthetic
aaaaauacacauuugguuuca

SEQ ID NO: 16081 - RNA, 23 nt, Artificial Sequence
  Synthetic
ugaaaaauacacauuugguuuca

SEQ ID NO: 16082 - RNA, 24 nt, Artificial Sequence
  Synthetic
cugaaaaauacacauuugguuuca

SEQ ID NO: 16083 - RNA, 18 nt, Artificial Sequence
  Synthetic
cuuaaguaaauaaaagga

SEQ ID NO: 16084 - RNA, 20 nt, Artificial Sequence
  Synthetic
agcuuaaguaaauaaaagga

SEQ ID NO: 16085 - RNA, 18 nt, Artificial Sequence
  Synthetic
caauuuugugaccaugga

SEQ ID NO: 16086 - RNA, 19 nt, Artificial Sequence
  Synthetic
ucaauuuugugaccaugga

SEQ ID NO: 16087 - RNA, 20 nt, Artificial Sequence
  Synthetic
cucaauuuugugaccaugga

SEQ ID NO: 16088 - RNA, 23 nt, Artificial Sequence
  Synthetic
uggcucaauuuugugaccaugga

SEQ ID NO: 16089 - RNA, 24 nt, Artificial Sequence
  Synthetic
cuggcucaauuuugugaccaugga

SEQ ID NO: 16090 - RNA, 19 nt, Artificial Sequence
  Synthetic
aguuuuaauuggaugcuga

SEQ ID NO: 16091 - RNA, 21 nt, Artificial Sequence
  Synthetic
uaaguuuuaauuggaugcuga

SEQ ID NO: 16092 - RNA, 22 nt, Artificial Sequence
  Synthetic
cuaaguuuuaauuggaugcuga

SEQ ID NO: 16093 - RNA, 23 nt, Artificial Sequence
  Synthetic
ucuaaguuuuaauuggaugcuga

SEQ ID NO: 16094 - RNA, 24 nt, Artificial Sequence
  Synthetic
aucuaaguuuuaauuggaugcuga

SEQ ID NO: 16095 - RNA, 18 nt, Artificial Sequence
  Synthetic
augguagucccccccaua

SEQ ID NO: 16096 - RNA, 19 nt, Artificial Sequence
  Synthetic
aaugguagucccccccaua

SEQ ID NO: 16097 - RNA, 22 nt, Artificial Sequence
  Synthetic
aggaaugguagucccccccaua

SEQ ID NO: 16098 - RNA, 23 nt, Artificial Sequence
  Synthetic
uaggaaugguagucccccccaua

SEQ ID NO: 16099 - RNA, 24 nt, Artificial Sequence
  Synthetic
cuaggaaugguagucccccccaua

SEQ ID NO: 16100 - RNA, 18 nt, Artificial Sequence
  Synthetic
caaguucaaaauaauaua

SEQ ID NO: 16101 - RNA, 19 nt, Artificial Sequence
  Synthetic
acaaguucaaaauaauaua

SEQ ID NO: 16102 - RNA, 21 nt, Artificial Sequence
  Synthetic
ugacaaguucaaaauaauaua

SEQ ID NO: 16103 - RNA, 22 nt, Artificial Sequence
  Synthetic
uugacaaguucaaaauaauaua

SEQ ID NO: 16104 - RNA, 23 nt, Artificial Sequence
  Synthetic
auugacaaguucaaaauaauaua

SEQ ID NO: 16105 - RNA, 24 nt, Artificial Sequence
  Synthetic
uauugacaaguucaaaauaauaua

SEQ ID NO: 16106 - RNA, 18 nt, Artificial Sequence
  Synthetic
cucauuagcaagcuucua

SEQ ID NO: 16107 - RNA, 19 nt, Artificial Sequence
  Synthetic
ucucauuagcaagcuucua

SEQ ID NO: 16108 - RNA, 24 nt, Artificial Sequence
  Synthetic
agggcucucauuagcaagcuucua

SEQ ID NO: 16109 - RNA, 18 nt, Artificial Sequence
  Synthetic
aaaauaauauaaugggua

SEQ ID NO: 16110 - RNA, 19 nt, Artificial Sequence
  Synthetic
caaaauaauauaaugggua

SEQ ID NO: 16111 - RNA, 20 nt, Artificial Sequence
  Synthetic
ucaaaauaauauaaugggua

SEQ ID NO: 16112 - RNA, 21 nt, Artificial Sequence
  Synthetic
uucaaaauaauauaaugggua

SEQ ID NO: 16113 - RNA, 23 nt, Artificial Sequence
  Synthetic
aguucaaaauaauauaaugggua

SEQ ID NO: 16114 - RNA, 24 nt, Artificial Sequence
  Synthetic
aaguucaaaauaauauaaugggua

SEQ ID NO: 16115 - RNA, 18 nt, Artificial Sequence
  Synthetic
aauauacuuugccaguua

SEQ ID NO: 16116 - RNA, 19 nt, Artificial Sequence
  Synthetic
uaauauacuuugccaguua

SEQ ID NO: 16117 - RNA, 20 nt, Artificial Sequence
  Synthetic
auaauauacuuugccaguua

SEQ ID NO: 16118 - RNA, 22 nt, Artificial Sequence
  Synthetic
agauaauauacuuugccaguua

SEQ ID NO: 16119 - RNA, 24 nt, Artificial Sequence
  Synthetic
agagauaauauacuuugccaguua

SEQ ID NO: 16120 - RNA, 18 nt, Artificial Sequence
  Synthetic
uauggccagauagagaac

SEQ ID NO: 16121 - RNA, 19 nt, Artificial Sequence
  Synthetic
uuauggccagauagagaac

SEQ ID NO: 16122 - RNA, 20 nt, Artificial Sequence
  Synthetic
uuuauggccagauagagaac

SEQ ID NO: 16123 - RNA, 21 nt, Artificial Sequence
  Synthetic
auuuauggccagauagagaac

SEQ ID NO: 16124 - RNA, 22 nt, Artificial Sequence
  Synthetic
uauuuauggccagauagagaac

SEQ ID NO: 16125 - RNA, 24 nt, Artificial Sequence
  Synthetic
uguauuuauggccagauagagaac

SEQ ID NO: 16126 - RNA, 18 nt, Artificial Sequence
  Synthetic
uggcucaauuuugugacc

SEQ ID NO: 16127 - RNA, 19 nt, Artificial Sequence
  Synthetic
cuggcucaauuuugugacc

SEQ ID NO: 16128 - RNA, 20 nt, Artificial Sequence
  Synthetic
ucuggcucaauuuugugacc

SEQ ID NO: 16129 - RNA, 21 nt, Artificial Sequence
  Synthetic
aucuggcucaauuuugugacc

SEQ ID NO: 16130 - RNA, 22 nt, Artificial Sequence
  Synthetic
uaucuggcucaauuuugugacc

SEQ ID NO: 16131 - RNA, 23 nt, Artificial Sequence
  Synthetic
cuaucuggcucaauuuugugacc

SEQ ID NO: 16132 - RNA, 24 nt, Artificial Sequence
  Synthetic
ccuaucuggcucaauuuugugacc

SEQ ID NO: 16133 - RNA, 19 nt, Artificial Sequence
  Synthetic
ugauguauccccaagugcc

SEQ ID NO: 16134 - RNA, 20 nt, Artificial Sequence
  Synthetic
augauguauccccaagugcc

SEQ ID NO: 16135 - RNA, 18 nt, Artificial Sequence
  Synthetic
uccuaaaacuacauugcc

SEQ ID NO: 16136 - RNA, 19 nt, Artificial Sequence
  Synthetic
uuccuaaaacuacauugcc

SEQ ID NO: 16137 - RNA, 21 nt, Artificial Sequence
  Synthetic
uguuccuaaaacuacauugcc

SEQ ID NO: 16138 - RNA, 22 nt, Artificial Sequence
  Synthetic
auguuccuaaaacuacauugcc

SEQ ID NO: 16139 - RNA, 23 nt, Artificial Sequence
  Synthetic
cauguuccuaaaacuacauugcc

SEQ ID NO: 16140 - RNA, 24 nt, Artificial Sequence
  Synthetic
ccauguuccuaaaacuacauugcc

SEQ ID NO: 16141 - RNA, 19 nt, Artificial Sequence
  Synthetic
ugaaaaaucccagagacuc

SEQ ID NO: 16142 - RNA, 21 nt, Artificial Sequence
  Synthetic
ugugaaaaaucccagagacuc

SEQ ID NO: 16143 - RNA, 22 nt, Artificial Sequence
  Synthetic
augugaaaaaucccagagacuc

SEQ ID NO: 16144 - RNA, 23 nt, Artificial Sequence
  Synthetic
aaugugaaaaaucccagagacuc

SEQ ID NO: 16145 - RNA, 24 nt, Artificial Sequence
  Synthetic
aaaugugaaaaaucccagagacuc

SEQ ID NO: 16146 - RNA, 18 nt, Artificial Sequence
  Synthetic
cuugggccacucauaguc

SEQ ID NO: 16147 - RNA, 19 nt, Artificial Sequence
  Synthetic
ccuugggccacucauaguc

SEQ ID NO: 16148 - RNA, 20 nt, Artificial Sequence
  Synthetic
cccuugggccacucauaguc

SEQ ID NO: 16149 - RNA, 21 nt, Artificial Sequence
  Synthetic
ccccuugggccacucauaguc

SEQ ID NO: 16150 - RNA, 22 nt, Artificial Sequence
  Synthetic
accccuugggccacucauaguc

SEQ ID NO: 16151 - RNA, 23 nt, Artificial Sequence
  Synthetic
uaccccuugggccacucauaguc

SEQ ID NO: 16152 - RNA, 24 nt, Artificial Sequence
  Synthetic
uuaccccuugggccacucauaguc

SEQ ID NO: 16153 - RNA, 21 nt, Artificial Sequence
  Synthetic
auuucuccuuugauggagaag

SEQ ID NO: 16154 - RNA, 22 nt, Artificial Sequence
  Synthetic
cauuucuccuuugauggagaag

SEQ ID NO: 16155 - RNA, 23 nt, Artificial Sequence
  Synthetic
ccauuucuccuuugauggagaag

SEQ ID NO: 16156 - RNA, 24 nt, Artificial Sequence
  Synthetic
uccauuucuccuuugauggagaag

SEQ ID NO: 16157 - RNA, 21 nt, Artificial Sequence
  Synthetic
cagauaaaagggugagugaag

SEQ ID NO: 16158 - RNA, 22 nt, Artificial Sequence
  Synthetic
ccagauaaaagggugagugaag

SEQ ID NO: 16159 - RNA, 24 nt, Artificial Sequence
  Synthetic
ugccagauaaaagggugagugaag

SEQ ID NO: 16160 - RNA, 18 nt, Artificial Sequence
  Synthetic
cuuauuagagaccaugag

SEQ ID NO: 16161 - RNA, 19 nt, Artificial Sequence
  Synthetic
ucuuauuagagaccaugag

SEQ ID NO: 16162 - RNA, 21 nt, Artificial Sequence
  Synthetic
ugucuuauuagagaccaugag

SEQ ID NO: 16163 - RNA, 22 nt, Artificial Sequence
  Synthetic
uugucuuauuagagaccaugag

SEQ ID NO: 16164 - RNA, 23 nt, Artificial Sequence
  Synthetic
uuugucuuauuagagaccaugag

SEQ ID NO: 16165 - RNA, 24 nt, Artificial Sequence
  Synthetic
auuugucuuauuagagaccaugag

SEQ ID NO: 16166 - RNA, 18 nt, Artificial Sequence
  Synthetic
cugaugccagauaaaagg

SEQ ID NO: 16167 - RNA, 19 nt, Artificial Sequence
  Synthetic
ccugaugccagauaaaagg

SEQ ID NO: 16168 - RNA, 18 nt, Artificial Sequence
  Synthetic
uaccuguuacaugccagg

SEQ ID NO: 16169 - RNA, 20 nt, Artificial Sequence
  Synthetic
aguaccuguuacaugccagg

SEQ ID NO: 16170 - RNA, 22 nt, Artificial Sequence
  Synthetic
ugaguaccuguuacaugccagg

SEQ ID NO: 16171 - RNA, 23 nt, Artificial Sequence
  Synthetic
uugaguaccuguuacaugccagg

SEQ ID NO: 16172 - RNA, 24 nt, Artificial Sequence
  Synthetic
uuugaguaccuguuacaugccagg

SEQ ID NO: 16173 - RNA, 18 nt, Artificial Sequence
  Synthetic
agucuagaaugaacuagg

SEQ ID NO: 16174 - RNA, 19 nt, Artificial Sequence
  Synthetic
uagucuagaaugaacuagg

SEQ ID NO: 16175 - RNA, 20 nt, Artificial Sequence
  Synthetic
auagucuagaaugaacuagg

SEQ ID NO: 16176 - RNA, 21 nt, Artificial Sequence
  Synthetic
cauagucuagaaugaacuagg

SEQ ID NO: 16177 - RNA, 22 nt, Artificial Sequence
  Synthetic
ucauagucuagaaugaacuagg

SEQ ID NO: 16178 - RNA, 23 nt, Artificial Sequence
  Synthetic
cucauagucuagaaugaacuagg

SEQ ID NO: 16179 - RNA, 24 nt, Artificial Sequence
  Synthetic
acucauagucuagaaugaacuagg

SEQ ID NO: 16180 - RNA, 18 nt, Artificial Sequence
  Synthetic
ugauuaaucagaguaggg

SEQ ID NO: 16181 - RNA, 19 nt, Artificial Sequence
  Synthetic
augauuaaucagaguaggg

SEQ ID NO: 16182 - RNA, 20 nt, Artificial Sequence
  Synthetic
aaugauuaaucagaguaggg

SEQ ID NO: 16183 - RNA, 24 nt, Artificial Sequence
  Synthetic
agggaaugauuaaucagaguaggg

SEQ ID NO: 16184 - RNA, 18 nt, Artificial Sequence
  Synthetic
uuuauugaaauauuuugg

SEQ ID NO: 16185 - RNA, 19 nt, Artificial Sequence
  Synthetic
auuuauugaaauauuuugg

SEQ ID NO: 16186 - RNA, 20 nt, Artificial Sequence
  Synthetic
aauuuauugaaauauuuugg

SEQ ID NO: 16187 - RNA, 18 nt, Artificial Sequence
  Synthetic
aacaugaaucugaauuug

SEQ ID NO: 16188 - RNA, 20 nt, Artificial Sequence
  Synthetic
agaacaugaaucugaauuug

SEQ ID NO: 16189 - RNA, 18 nt, Artificial Sequence
  Synthetic
cagauagagaacaugaau

SEQ ID NO: 16190 - RNA, 19 nt, Artificial Sequence
  Synthetic
ccagauagagaacaugaau

SEQ ID NO: 16191 - RNA, 18 nt, Artificial Sequence
  Synthetic
ugguaacuugacaguaau

SEQ ID NO: 16192 - RNA, 19 nt, Artificial Sequence
  Synthetic
augguaacuugacaguaau

SEQ ID NO: 16193 - RNA, 21 nt, Artificial Sequence
  Synthetic
uuaugguaacuugacaguaau

SEQ ID NO: 16194 - RNA, 22 nt, Artificial Sequence
  Synthetic
cuuaugguaacuugacaguaau

SEQ ID NO: 16195 - RNA, 23 nt, Artificial Sequence
  Synthetic
acuuaugguaacuugacaguaau

SEQ ID NO: 16196 - RNA, 24 nt, Artificial Sequence
  Synthetic
uacuuaugguaacuugacaguaau

SEQ ID NO: 16197 - RNA, 23 nt, Artificial Sequence
  Synthetic
uggaugcugagggaaugauuaau

SEQ ID NO: 16198 - RNA, 24 nt, Artificial Sequence
  Synthetic
uuggaugcugagggaaugauuaau

SEQ ID NO: 16199 - RNA, 18 nt, Artificial Sequence
  Synthetic
cuuucaaaaccuuuauau

SEQ ID NO: 16200 - RNA, 20 nt, Artificial Sequence
  Synthetic
ugcuuucaaaaccuuuauau

SEQ ID NO: 16201 - RNA, 18 nt, Artificial Sequence
  Synthetic
uaucuccucucagccacu

SEQ ID NO: 16202 - RNA, 19 nt, Artificial Sequence
  Synthetic
auaucuccucucagccacu

SEQ ID NO: 16203 - RNA, 20 nt, Artificial Sequence
  Synthetic
aauaucuccucucagccacu

SEQ ID NO: 16204 - RNA, 22 nt, Artificial Sequence
  Synthetic
agaauaucuccucucagccacu

SEQ ID NO: 16205 - RNA, 23 nt, Artificial Sequence
  Synthetic
uagaauaucuccucucagccacu

SEQ ID NO: 16206 - RNA, 18 nt, Artificial Sequence
  Synthetic
cauauuuagcuucuuacu

SEQ ID NO: 16207 - RNA, 19 nt, Artificial Sequence
  Synthetic
ccauauuuagcuucuuacu

SEQ ID NO: 16208 - RNA, 20 nt, Artificial Sequence
  Synthetic
uccauauuuagcuucuuacu

SEQ ID NO: 16209 - RNA, 21 nt, Artificial Sequence
  Synthetic
cuccauauuuagcuucuuacu

SEQ ID NO: 16210 - RNA, 23 nt, Artificial Sequence
  Synthetic
ugcuccauauuuagcuucuuacu

SEQ ID NO: 16211 - RNA, 24 nt, Artificial Sequence
  Synthetic
cugcuccauauuuagcuucuuacu

SEQ ID NO: 16212 - RNA, 18 nt, Artificial Sequence
  Synthetic
uguauugccuugcucucu

SEQ ID NO: 16213 - RNA, 19 nt, Artificial Sequence
  Synthetic
cuguauugccuugcucucu

SEQ ID NO: 16214 - RNA, 23 nt, Artificial Sequence
  Synthetic
aggucuguauugccuugcucucu

SEQ ID NO: 16215 - RNA, 18 nt, Artificial Sequence
  Synthetic
ucaaagaauuaagcuagu

SEQ ID NO: 16216 - RNA, 19 nt, Artificial Sequence
  Synthetic
uucaaagaauuaagcuagu

SEQ ID NO: 16217 - RNA, 21 nt, Artificial Sequence
  Synthetic
uauucaaagaauuaagcuagu

SEQ ID NO: 16218 - RNA, 22 nt, Artificial Sequence
  Synthetic
uuauucaaagaauuaagcuagu

SEQ ID NO: 16219 - RNA, 23 nt, Artificial Sequence
  Synthetic
uuuauucaaagaauuaagcuagu

SEQ ID NO: 16220 - RNA, 24 nt, Artificial Sequence
  Synthetic
uuuuauucaaagaauuaagcuagu

SEQ ID NO: 16221 - RNA, 18 nt, Artificial Sequence
  Synthetic
ccguuccaagauuguagu

SEQ ID NO: 16222 - RNA, 19 nt, Artificial Sequence
  Synthetic
uccguuccaagauuguagu

SEQ ID NO: 16223 - RNA, 20 nt, Artificial Sequence
  Synthetic
auccguuccaagauuguagu

SEQ ID NO: 16224 - RNA, 21 nt, Artificial Sequence
  Synthetic
cauccguuccaagauuguagu

SEQ ID NO: 16225 - RNA, 22 nt, Artificial Sequence
  Synthetic
acauccguuccaagauuguagu

SEQ ID NO: 16226 - RNA, 23 nt, Artificial Sequence
  Synthetic
cacauccguuccaagauuguagu

SEQ ID NO: 16227 - RNA, 24 nt, Artificial Sequence
  Synthetic
acacauccguuccaagauuguagu

SEQ ID NO: 16228 - RNA, 18 nt, Artificial Sequence
  Synthetic
ccuuuccaaucaaaaggu

SEQ ID NO: 16229 - RNA, 19 nt, Artificial Sequence
  Synthetic
uccuuuccaaucaaaaggu

SEQ ID NO: 16230 - RNA, 20 nt, Artificial Sequence
  Synthetic
uuccuuuccaaucaaaaggu

SEQ ID NO: 16231 - RNA, 21 nt, Artificial Sequence
  Synthetic
uuuccuuuccaaucaaaaggu

SEQ ID NO: 16232 - RNA, 23 nt, Artificial Sequence
  Synthetic
aguuuccuuuccaaucaaaaggu

SEQ ID NO: 16233 - RNA, 24 nt, Artificial Sequence
  Synthetic
caguuuccuuuccaaucaaaaggu

SEQ ID NO: 16234 - RNA, 18 nt, Artificial Sequence
  Synthetic
cccggccuauuacuccuu

SEQ ID NO: 16235 - RNA, 19 nt, Artificial Sequence
  Synthetic
ccccggccuauuacuccuu

SEQ ID NO: 16236 - RNA, 21 nt, Artificial Sequence
  Synthetic
ugccccggccuauuacuccuu

SEQ ID NO: 16237 - RNA, 22 nt, Artificial Sequence
  Synthetic
cugccccggccuauuacuccuu

SEQ ID NO: 16238 - RNA, 23 nt, Artificial Sequence
  Synthetic
acugccccggccuauuacuccuu

SEQ ID NO: 16239 - RNA, 24 nt, Artificial Sequence
  Synthetic
cacugccccggccuauuacuccuu

SEQ ID NO: 16240 - RNA, 18 nt, Artificial Sequence
  Synthetic
ucugaguaaccaaauguu

SEQ ID NO: 16241 - RNA, 19 nt, Artificial Sequence
  Synthetic
cucugaguaaccaaauguu

SEQ ID NO: 16242 - RNA, 20 nt, Artificial Sequence
  Synthetic
acucugaguaaccaaauguu

SEQ ID NO: 16243 - RNA, 21 nt, Artificial Sequence
  Synthetic
uacucugaguaaccaaauguu

SEQ ID NO: 16244 - RNA, 22 nt, Artificial Sequence
  Synthetic
uuacucugaguaaccaaauguu

SEQ ID NO: 16245 - RNA, 23 nt, Artificial Sequence
  Synthetic
cuuacucugaguaaccaaauguu

SEQ ID NO: 16246 - RNA, 24 nt, Artificial Sequence
  Synthetic
ucuuacucugaguaaccaaauguu

SEQ ID NO: 16247 - RNA, 18 nt, Artificial Sequence
  Synthetic
ucaggauaugaacuuuuu

SEQ ID NO: 16248 - RNA, 20 nt, Artificial Sequence
  Synthetic
agucaggauaugaacuuuuu

SEQ ID NO: 16249 - RNA, 21 nt, Artificial Sequence
  Synthetic
uagucaggauaugaacuuuuu

SEQ ID NO: 16250 - RNA, 23 nt, Artificial Sequence
  Synthetic
uguagucaggauaugaacuuuuu

SEQ ID NO: 16251 - RNA, 24 nt, Artificial Sequence
  Synthetic
uuguagucaggauaugaacuuuuu

SEQ ID NO: 16252 - RNA, 24 nt, Artificial Sequence
  Synthetic
gaauguuagcuaugaaagaaaaaa

SEQ ID NO: 16253 - RNA, 23 nt, Artificial Sequence
  Synthetic
guaaaauagguauauuuuuuaaa

SEQ ID NO: 16254 - RNA, 21 nt, Artificial Sequence
  Synthetic
guuucugucacuggcaaucaa

SEQ ID NO: 16255 - RNA, 22 nt, Artificial Sequence
  Synthetic
gguuucugucacuggcaaucaa

SEQ ID NO: 16256 - RNA, 23 nt, Artificial Sequence
  Synthetic
ggguuucugucacuggcaaucaa

SEQ ID NO: 16257 - RNA, 21 nt, Artificial Sequence
  Synthetic
gcuaugaaagaaaaaauagaa

SEQ ID NO: 16258 - RNA, 23 nt, Artificial Sequence
  Synthetic
gaaguagagagaccaggagagca

SEQ ID NO: 16259 - RNA, 22 nt, Artificial Sequence
  Synthetic
gaucagaugggaaagccaagga

SEQ ID NO: 16260 - RNA, 23 nt, Artificial Sequence
  Synthetic
ggaucagaugggaaagccaagga

SEQ ID NO: 16261 - RNA, 21 nt, Artificial Sequence
  Synthetic
gauucauucaacaaauauuua

SEQ ID NO: 16262 - RNA, 22 nt, Artificial Sequence
  Synthetic
ggauucauucaacaaauauuua

SEQ ID NO: 16263 - RNA, 22 nt, Artificial Sequence
  Synthetic
gaucacaccacuacacuccagc

SEQ ID NO: 16264 - RNA, 24 nt, Artificial Sequence
  Synthetic
gagaucacaccacuacacuccagc

SEQ ID NO: 16265 - RNA, 18 nt, Artificial Sequence
  Synthetic
ggcagaucacuugagguc

SEQ ID NO: 16266 - RNA, 19 nt, Artificial Sequence
  Synthetic
gggcagaucacuugagguc

SEQ ID NO: 16267 - RNA, 21 nt, Artificial Sequence
  Synthetic
gcgggcagaucacuugagguc

SEQ ID NO: 16268 - RNA, 22 nt, Artificial Sequence
  Synthetic
ggcgggcagaucacuugagguc

SEQ ID NO: 16269 - RNA, 21 nt, Artificial Sequence
  Synthetic
gugggcagaucacuugagguc

SEQ ID NO: 16270 - RNA, 22 nt, Artificial Sequence
  Synthetic
ggugggcagaucacuugagguc

SEQ ID NO: 16271 - RNA, 22 nt, Artificial Sequence
  Synthetic
gcuacucgagaggcugaggcag

SEQ ID NO: 16272 - RNA, 21 nt, Artificial Sequence
  Synthetic
gauucgcuugaacccaggagg

SEQ ID NO: 16273 - RNA, 23 nt, Artificial Sequence
  Synthetic
gagauucgcuugaacccaggagg

SEQ ID NO: 16274 - RNA, 21 nt, Artificial Sequence
  Synthetic
gagauaaugaugcuuuccacu

SEQ ID NO: 16275 - RNA, 18 nt, Artificial Sequence
  Synthetic
gcccuauucuaggcacuu

SEQ ID NO: 16276 - RNA, 19 nt, Artificial Sequence
  Synthetic
ggcccuauucuaggcacuu

SEQ ID NO: 16277 - RNA, 23 nt, Artificial Sequence
  Synthetic
gccaggcccuauucuaggcacuu

SEQ ID NO: 16278 - RNA, 24 nt, Artificial Sequence
  Synthetic
gcaaacucugccuccuggguucaa

SEQ ID NO: 16279 - RNA, 18 nt, Artificial Sequence
  Synthetic
ggcuaauuuuuguagaga

SEQ ID NO: 16280 - RNA, 22 nt, Artificial Sequence
  Synthetic
gccuggcuaauuuuuguagaga

SEQ ID NO: 16281 - RNA, 23 nt, Artificial Sequence
  Synthetic
ggccuggcuaauuuuuguagaga

SEQ ID NO: 16282 - RNA, 19 nt, Artificial Sequence
  Synthetic
guugcuguuguuuuugaga

SEQ ID NO: 16283 - RNA, 22 nt, Artificial Sequence
  Synthetic
guuguugcuguuguuuuugaga

SEQ ID NO: 16284 - RNA, 19 nt, Artificial Sequence
  Synthetic
guguuguuuguuuuugaga

SEQ ID NO: 16285 - RNA, 23 nt, Artificial Sequence
  Synthetic
guuuguguuguuuguuuuugaga

SEQ ID NO: 16286 - RNA, 20 nt, Artificial Sequence
  Synthetic
guuuuguuuuuuauuuuuua

SEQ ID NO: 16287 - RNA, 24 nt, Artificial Sequence
  Synthetic
guuuaugauguauccccaagugcc

SEQ ID NO: 16288 - RNA, 21 nt, Artificial Sequence
  Synthetic
gucucgcugugucacccaggc

SEQ ID NO: 16289 - RNA, 23 nt, Artificial Sequence
  Synthetic
gagucucgcugugucacccaggc

SEQ ID NO: 16290 - RNA, 21 nt, Artificial Sequence
  Synthetic
gucuugcucuguugcccaggc

SEQ ID NO: 16291 - RNA, 23 nt, Artificial Sequence
  Synthetic
gagucuugcucuguugcccaggc

SEQ ID NO: 16292 - RNA, 24 nt, Artificial Sequence
  Synthetic
gcccaccuuggccucccaaaaugc

SEQ ID NO: 16293 - RNA, 20 nt, Artificial Sequence
  Synthetic
gauucuccugccucagccuc

SEQ ID NO: 16294 - RNA, 22 nt, Artificial Sequence
  Synthetic
gugauucuccugccucagccuc

SEQ ID NO: 16295 - RNA, 21 nt, Artificial Sequence
  Synthetic
gcucacugcaaacucugccuc

SEQ ID NO: 16296 - RNA, 21 nt, Artificial Sequence
  Synthetic
guucaagcgaaucucagucuc

SEQ ID NO: 16297 - RNA, 22 nt, Artificial Sequence
  Synthetic
gguucaagcgaaucucagucuc

SEQ ID NO: 16298 - RNA, 23 nt, Artificial Sequence
  Synthetic
ggguucaagcgaaucucagucuc

SEQ ID NO: 16299 - RNA, 21 nt, Artificial Sequence
  Synthetic
gcucacugcaaacuucgucuc

SEQ ID NO: 16300 - RNA, 22 nt, Artificial Sequence
  Synthetic
ggcucacugcaaacuucgucuc

SEQ ID NO: 16301 - RNA, 19 nt, Artificial Sequence
  Synthetic
gauaaaagggugagugaag

SEQ ID NO: 16302 - RNA, 19 nt, Artificial Sequence
  Synthetic
gccucagccucucgaguag

SEQ ID NO: 16303 - RNA, 21 nt, Artificial Sequence
  Synthetic
ggccugaugccagauaaaagg

SEQ ID NO: 16304 - RNA, 22 nt, Artificial Sequence
  Synthetic
gaaauuuauugaaauauuuugg

SEQ ID NO: 16305 - RNA, 21 nt, Artificial Sequence
  Synthetic
gagaacaugaaucugaauuug

SEQ ID NO: 16306 - RNA, 22 nt, Artificial Sequence
  Synthetic
guauauacucaauaaauauuug

SEQ ID NO: 16307 - RNA, 23 nt, Artificial Sequence
  Synthetic
gguauauacucaauaaauauuug

SEQ ID NO: 16308 - RNA, 21 nt, Artificial Sequence
  Synthetic
ggccagauagagaacaugaau

SEQ ID NO: 16309 - RNA, 18 nt, Artificial Sequence
  Synthetic
gcugagggaaugauuaau

SEQ ID NO: 16310 - RNA, 18 nt, Artificial Sequence
  Synthetic
gagccacuaugcccagcu

SEQ ID NO: 16311 - RNA, 20 nt, Artificial Sequence
  Synthetic
gugagccacuaugcccagcu

SEQ ID NO: 16312 - RNA, 22 nt, Artificial Sequence
  Synthetic
gugugagccacuaugcccagcu

SEQ ID NO: 16313 - RNA, 23 nt, Artificial Sequence
  Synthetic
ggugugagccacuaugcccagcu

SEQ ID NO: 16314 - RNA, 18 nt, Artificial Sequence
  Synthetic
gugcaaaugccaugaggu

SEQ ID NO: 16315 - RNA, 22 nt, Artificial Sequence
  Synthetic
gugugugcaaaugccaugaggu

SEQ ID NO: 16316 - RNA, 23 nt, Artificial Sequence
  Synthetic
ggugugugcaaaugccaugaggu

SEQ ID NO: 16317 - RNA, 24 nt, Artificial Sequence
  Synthetic
gcccgccuuggccucccaaagugu

SEQ ID NO: 16318 - RNA, 21 nt, Artificial Sequence
  Synthetic
uguuagcuaugaaagaaaaaa

SEQ ID NO: 16319 - RNA, 22 nt, Artificial Sequence
  Synthetic
auguuagcuaugaaagaaaaaa

SEQ ID NO: 16320 - RNA, 23 nt, Artificial Sequence
  Synthetic
aauguuagcuaugaaagaaaaaa

SEQ ID NO: 16321 - RNA, 18 nt, Artificial Sequence
  Synthetic
uuuacuuaagcuaguaaa

SEQ ID NO: 16322 - RNA, 19 nt, Artificial Sequence
  Synthetic
auuuacuuaagcuaguaaa

SEQ ID NO: 16323 - RNA, 20 nt, Artificial Sequence
  Synthetic
uauuuacuuaagcuaguaaa

SEQ ID NO: 16324 - RNA, 18 nt, Artificial Sequence
  Synthetic
auagguauauuuuuuaaa

SEQ ID NO: 16325 - RNA, 19 nt, Artificial Sequence
  Synthetic
aauagguauauuuuuuaaa

SEQ ID NO: 16326 - RNA, 20 nt, Artificial Sequence
  Synthetic
aaauagguauauuuuuuaaa

SEQ ID NO: 16327 - RNA, 21 nt, Artificial Sequence
  Synthetic
aaaauagguauauuuuuuaaa

SEQ ID NO: 16328 - RNA, 22 nt, Artificial Sequence
  Synthetic
uaaaauagguauauuuuuuaaa

SEQ ID NO: 16329 - RNA, 24 nt, Artificial Sequence
  Synthetic
aguaaaauagguauauuuuuuaaa

SEQ ID NO: 16330 - RNA, 18 nt, Artificial Sequence
  Synthetic
ucugucacuggcaaucaa

SEQ ID NO: 16331 - RNA, 19 nt, Artificial Sequence
  Synthetic
uucugucacuggcaaucaa

SEQ ID NO: 16332 - RNA, 20 nt, Artificial Sequence
  Synthetic
uuucugucacuggcaaucaa

SEQ ID NO: 16333 - RNA, 24 nt, Artificial Sequence
  Synthetic
uggguuucugucacuggcaaucaa

SEQ ID NO: 16334 - RNA, 18 nt, Artificial Sequence
  Synthetic
uucuccaucaaaggagaa

SEQ ID NO: 16335 - RNA, 19 nt, Artificial Sequence
  Synthetic
cuucuccaucaaaggagaa

SEQ ID NO: 16336 - RNA, 20 nt, Artificial Sequence
  Synthetic
ccuucuccaucaaaggagaa

SEQ ID NO: 16337 - RNA, 18 nt, Artificial Sequence
  Synthetic
augaaagaaaaaauagaa

SEQ ID NO: 16338 - RNA, 19 nt, Artificial Sequence
  Synthetic
uaugaaagaaaaaauagaa

SEQ ID NO: 16339 - RNA, 22 nt, Artificial Sequence
  Synthetic
agcuaugaaagaaaaaauagaa

SEQ ID NO: 16340 - RNA, 23 nt, Artificial Sequence
  Synthetic
uagcuaugaaagaaaaaauagaa

SEQ ID NO: 16341 - RNA, 24 nt, Artificial Sequence
  Synthetic
uuagcuaugaaagaaaaaauagaa

SEQ ID NO: 16342 - RNA, 18 nt, Artificial Sequence
  Synthetic
aaaugccaaaaaaaggaa

SEQ ID NO: 16343 - RNA, 19 nt, Artificial Sequence
  Synthetic
aaaaugccaaaaaaaggaa

SEQ ID NO: 16344 - RNA, 20 nt, Artificial Sequence
  Synthetic
caaaaugccaaaaaaaggaa

SEQ ID NO: 16345 - RNA, 21 nt, Artificial Sequence
  Synthetic
ucaaaaugccaaaaaaaggaa

SEQ ID NO: 16346 - RNA, 22 nt, Artificial Sequence
  Synthetic
uucaaaaugccaaaaaaaggaa

SEQ ID NO: 16347 - RNA, 23 nt, Artificial Sequence
  Synthetic
cuucaaaaugccaaaaaaaggaa

SEQ ID NO: 16348 - RNA, 24 nt, Artificial Sequence
  Synthetic
ccuucaaaaugccaaaaaaaggaa

SEQ ID NO: 16349 - RNA, 18 nt, Artificial Sequence
  Synthetic
aacaaacaaaaaacauaa

SEQ ID NO: 16350 - RNA, 19 nt, Artificial Sequence
  Synthetic
aaacaaacaaaaaacauaa

SEQ ID NO: 16351 - RNA, 21 nt, Artificial Sequence
  Synthetic
acaaacaaacaaaaaacauaa

SEQ ID NO: 16352 - RNA, 22 nt, Artificial Sequence
  Synthetic
cacaaacaaacaaaaaacauaa

SEQ ID NO: 16353 - RNA, 23 nt, Artificial Sequence
  Synthetic
acacaaacaaacaaaaaacauaa

SEQ ID NO: 16354 - RNA, 24 nt, Artificial Sequence
  Synthetic
aacacaaacaaacaaaaaacauaa

SEQ ID NO: 16355 - RNA, 18 nt, Artificial Sequence
  Synthetic
uuauaagaaaagaaguaa

SEQ ID NO: 16356 - RNA, 19 nt, Artificial Sequence
  Synthetic
uuuauaagaaaagaaguaa

SEQ ID NO: 16357 - RNA, 20 nt, Artificial Sequence
  Synthetic
uuuuauaagaaaagaaguaa

SEQ ID NO: 16358 - RNA, 21 nt, Artificial Sequence
  Synthetic
auuuuauaagaaaagaaguaa

SEQ ID NO: 16359 - RNA, 22 nt, Artificial Sequence
  Synthetic
aauuuuauaagaaaagaaguaa

SEQ ID NO: 16360 - RNA, 23 nt, Artificial Sequence
  Synthetic
caauuuuauaagaaaagaaguaa

SEQ ID NO: 16361 - RNA, 24 nt, Artificial Sequence
  Synthetic
ccaauuuuauaagaaaagaaguaa

SEQ ID NO: 16362 - RNA, 21 nt, Artificial Sequence
  Synthetic
aguagagagaccaggagagca

SEQ ID NO: 16363 - RNA, 22 nt, Artificial Sequence
  Synthetic
aaguagagagaccaggagagca

SEQ ID NO: 16364 - RNA, 24 nt, Artificial Sequence
  Synthetic
ugaaguagagagaccaggagagca

SEQ ID NO: 16365 - RNA, 21 nt, Artificial Sequence
  Synthetic
aucagaugggaaagccaagga

SEQ ID NO: 16366 - RNA, 24 nt, Artificial Sequence
  Synthetic
uggaucagaugggaaagccaagga

SEQ ID NO: 16367 - RNA, 18 nt, Artificial Sequence
  Synthetic
ucauucaacaaauauuua

SEQ ID NO: 16368 - RNA, 19 nt, Artificial Sequence
  Synthetic
uucauucaacaaauauuua

SEQ ID NO: 16369 - RNA, 20 nt, Artificial Sequence
  Synthetic
auucauucaacaaauauuua

SEQ ID NO: 16370 - RNA, 23 nt, Artificial Sequence
  Synthetic
uggauucauucaacaaauauuua

SEQ ID NO: 16371 - RNA, 24 nt, Artificial Sequence
  Synthetic
auggauucauucaacaaauauuua

SEQ ID NO: 16372 - RNA, 18 nt, Artificial Sequence
  Synthetic
acaccacuacacuccagc

SEQ ID NO: 16373 - RNA, 19 nt, Artificial Sequence
  Synthetic
cacaccacuacacuccagc

SEQ ID NO: 16374 - RNA, 20 nt, Artificial Sequence
  Synthetic
ucacaccacuacacuccagc

SEQ ID NO: 16375 - RNA, 21 nt, Artificial Sequence
  Synthetic
aucacaccacuacacuccagc

SEQ ID NO: 16376 - RNA, 23 nt, Artificial Sequence
  Synthetic
agaucacaccacuacacuccagc

SEQ ID NO: 16377 - RNA, 23 nt, Artificial Sequence
  Synthetic
aggcgggcagaucacuugagguc

SEQ ID NO: 16378 - RNA, 24 nt, Artificial Sequence
  Synthetic
aaggcgggcagaucacuugagguc

SEQ ID NO: 16379 - RNA, 23 nt, Artificial Sequence
  Synthetic
aggugggcagaucacuugagguc

SEQ ID NO: 16380 - RNA, 24 nt, Artificial Sequence
  Synthetic
aaggugggcagaucacuugagguc

SEQ ID NO: 16381 - RNA, 18 nt, Artificial Sequence
  Synthetic
cucgagaggcugaggcag

SEQ ID NO: 16382 - RNA, 19 nt, Artificial Sequence
  Synthetic
acucgagaggcugaggcag

SEQ ID NO: 16383 - RNA, 20 nt, Artificial Sequence
  Synthetic
uacucgagaggcugaggcag

SEQ ID NO: 16384 - RNA, 21 nt, Artificial Sequence
  Synthetic
cuacucgagaggcugaggcag

SEQ ID NO: 16385 - RNA, 23 nt, Artificial Sequence
  Synthetic
agcuacucgagaggcugaggcag

SEQ ID NO: 16386 - RNA, 24 nt, Artificial Sequence
  Synthetic
cagcuacucgagaggcugaggcag

SEQ ID NO: 16387 - RNA, 21 nt, Artificial Sequence
  Synthetic
ccugaggagaaggcaaggucg

SEQ ID NO: 16388 - RNA, 22 nt, Artificial Sequence
  Synthetic
accugaggagaaggcaaggucg

SEQ ID NO: 16389 - RNA, 23 nt, Artificial Sequence
  Synthetic
uaccugaggagaaggcaaggucg

SEQ ID NO: 16390 - RNA, 24 nt, Artificial Sequence
  Synthetic
uuaccugaggagaaggcaaggucg

SEQ ID NO: 16391 - RNA, 18 nt, Artificial Sequence
  Synthetic
ucgcuugaacccaggagg

SEQ ID NO: 16392 - RNA, 19 nt, Artificial Sequence
  Synthetic
uucgcuugaacccaggagg

SEQ ID NO: 16393 - RNA, 20 nt, Artificial Sequence
  Synthetic
auucgcuugaacccaggagg

SEQ ID NO: 16394 - RNA, 22 nt, Artificial Sequence
  Synthetic
agauucgcuugaacccaggagg

SEQ ID NO: 16395 - RNA, 24 nt, Artificial Sequence
  Synthetic
ugagauucgcuugaacccaggagg

SEQ ID NO: 16396 - RNA, 21 nt, Artificial Sequence
  Synthetic
uuuuuaaauugaaucaacaug

SEQ ID NO: 16397 - RNA, 22 nt, Artificial Sequence
  Synthetic
uuuuuuaaauugaaucaacaug

SEQ ID NO: 16398 - RNA, 23 nt, Artificial Sequence
  Synthetic
auuuuuuaaauugaaucaacaug

SEQ ID NO: 16399 - RNA, 24 nt, Artificial Sequence
  Synthetic
uauuuuuuaaauugaaucaacaug

SEQ ID NO: 16400 - RNA, 18 nt, Artificial Sequence
  Synthetic
aauuagccaggcauugug

SEQ ID NO: 16401 - RNA, 19 nt, Artificial Sequence
  Synthetic
aaauuagccaggcauugug

SEQ ID NO: 16402 - RNA, 20 nt, Artificial Sequence
  Synthetic
aaaauuagccaggcauugug

SEQ ID NO: 16403 - RNA, 21 nt, Artificial Sequence
  Synthetic
aaaaauuagccaggcauugug

SEQ ID NO: 16404 - RNA, 22 nt, Artificial Sequence
  Synthetic
caaaaauuagccaggcauugug

SEQ ID NO: 16405 - RNA, 23 nt, Artificial Sequence
  Synthetic
acaaaaauuagccaggcauugug

SEQ ID NO: 16406 - RNA, 24 nt, Artificial Sequence
  Synthetic
uacaaaaauuagccaggcauugug

SEQ ID NO: 16407 - RNA, 18 nt, Artificial Sequence
  Synthetic
aaugccaccagguggcau

SEQ ID NO: 16408 - RNA, 19 nt, Artificial Sequence
  Synthetic
aaaugccaccagguggcau

SEQ ID NO: 16409 - RNA, 20 nt, Artificial Sequence
  Synthetic
caaaugccaccagguggcau

SEQ ID NO: 16410 - RNA, 22 nt, Artificial Sequence
  Synthetic
agagauaaugaugcuuuccacu

SEQ ID NO: 16411 - RNA, 23 nt, Artificial Sequence
  Synthetic
uagagauaaugaugcuuuccacu

SEQ ID NO: 16412 - RNA, 24 nt, Artificial Sequence
  Synthetic
auagagauaaugaugcuuuccacu

SEQ ID NO: 16413 - RNA, 18 nt, Artificial Sequence
  Synthetic
uauauuuucuauuauagu

SEQ ID NO: 16414 - RNA, 19 nt, Artificial Sequence
  Synthetic
auauauuuucuauuauagu

SEQ ID NO: 16415 - RNA, 20 nt, Artificial Sequence
  Synthetic
uauauauuuucuauuauagu

SEQ ID NO: 16416 - RNA, 21 nt, Artificial Sequence
  Synthetic
uuauauauuuucuauuauagu

SEQ ID NO: 16417 - RNA, 22 nt, Artificial Sequence
  Synthetic
auuauauauuuucuauuauagu

SEQ ID NO: 16418 - RNA, 23 nt, Artificial Sequence
  Synthetic
aauuauauauuuucuauuauagu

SEQ ID NO: 16419 - RNA, 24 nt, Artificial Sequence
  Synthetic
aaauuauauauuuucuauuauagu

SEQ ID NO: 16420 - RNA, 18 nt, Artificial Sequence
  Synthetic
acaaaaauaauagaacgu

SEQ ID NO: 16421 - RNA, 19 nt, Artificial Sequence
  Synthetic
aacaaaaauaauagaacgu

SEQ ID NO: 16422 - RNA, 20 nt, Artificial Sequence
  Synthetic
aaacaaaaauaauagaacgu

SEQ ID NO: 16423 - RNA, 21 nt, Artificial Sequence
  Synthetic
aaaacaaaaauaauagaacgu

SEQ ID NO: 16424 - RNA, 22 nt, Artificial Sequence
  Synthetic
caaaacaaaaauaauagaacgu

SEQ ID NO: 16425 - RNA, 23 nt, Artificial Sequence
  Synthetic
acaaaacaaaaauaauagaacgu

SEQ ID NO: 16426 - RNA, 24 nt, Artificial Sequence
  Synthetic
aacaaaacaaaaauaauagaacgu

SEQ ID NO: 16427 - RNA, 21 nt, Artificial Sequence
  Synthetic
caggcccuauucuaggcacuu

SEQ ID NO: 16428 - RNA, 22 nt, Artificial Sequence
  Synthetic
ccaggcccuauucuaggcacuu

SEQ ID NO: 16429 - RNA, 24 nt, Artificial Sequence
  Synthetic
ugccaggcccuauucuaggcacuu

SEQ ID NO: 16430 - RNA, 18 nt, Artificial Sequence
  Synthetic
ucugccuccuggguucaa

SEQ ID NO: 16431 - RNA, 19 nt, Artificial Sequence
  Synthetic
cucugccuccuggguucaa

SEQ ID NO: 16432 - RNA, 20 nt, Artificial Sequence
  Synthetic
acucugccuccuggguucaa

SEQ ID NO: 16433 - RNA, 21 nt, Artificial Sequence
  Synthetic
aacucugccuccuggguucaa

SEQ ID NO: 16434 - RNA, 22 nt, Artificial Sequence
  Synthetic
aaacucugccuccuggguucaa

SEQ ID NO: 16435 - RNA, 23 nt, Artificial Sequence
  Synthetic
caaacucugccuccuggguucaa

SEQ ID NO: 16436 - RNA, 18 nt, Artificial Sequence
  Synthetic
ugaauaucuaaguuuuaa

SEQ ID NO: 16437 - RNA, 19 nt, Artificial Sequence
  Synthetic
uugaauaucuaaguuuuaa

SEQ ID NO: 16438 - RNA, 20 nt, Artificial Sequence
  Synthetic
uuugaauaucuaaguuuuaa

SEQ ID NO: 16439 - RNA, 18 nt, Artificial Sequence
  Synthetic
uuuuauugauuuuauuca

SEQ ID NO: 16440 - RNA, 19 nt, Artificial Sequence
  Synthetic
uuuuuauugauuuuauuca

SEQ ID NO: 16441 - RNA, 20 nt, Artificial Sequence
  Synthetic
auuuuuauugauuuuauuca

SEQ ID NO: 16442 - RNA, 21 nt, Artificial Sequence
  Synthetic
uauuuuuauugauuuuauuca

SEQ ID NO: 16443 - RNA, 22 nt, Artificial Sequence
  Synthetic
uuauuuuuauugauuuuauuca

SEQ ID NO: 16444 - RNA, 23 nt, Artificial Sequence
  Synthetic
uuuauuuuuauugauuuuauuca

SEQ ID NO: 16445 - RNA, 24 nt, Artificial Sequence
  Synthetic
cuuuauuuuuauugauuuuauuca

SEQ ID NO: 16446 - RNA, 18 nt, Artificial Sequence
  Synthetic
aauacacauuugguuuca

SEQ ID NO: 16447 - RNA, 19 nt, Artificial Sequence
  Synthetic
aaauacacauuugguuuca

SEQ ID NO: 16448 - RNA, 20 nt, Artificial Sequence
  Synthetic
aaaauacacauuugguuuca

SEQ ID NO: 16449 - RNA, 19 nt, Artificial Sequence
  Synthetic
uggcuaauuuuuguagaga

SEQ ID NO: 16450 - RNA, 21 nt, Artificial Sequence
  Synthetic
ccuggcuaauuuuuguagaga

SEQ ID NO: 16451 - RNA, 24 nt, Artificial Sequence
  Synthetic
aggccuggcuaauuuuuguagaga

SEQ ID NO: 16452 - RNA, 18 nt, Artificial Sequence
  Synthetic
uugcuguuguuuuugaga

SEQ ID NO: 16453 - RNA, 20 nt, Artificial Sequence
  Synthetic
uguugcuguuguuuuugaga

SEQ ID NO: 16454 - RNA, 21 nt, Artificial Sequence
  Synthetic
uuguugcuguuguuuuugaga

SEQ ID NO: 16455 - RNA, 23 nt, Artificial Sequence
  Synthetic
uguuguugcuguuguuuuugaga

SEQ ID NO: 16456 - RNA, 24 nt, Artificial Sequence
  Synthetic
uuguuguugcuguuguuuuugaga

SEQ ID NO: 16457 - RNA, 18 nt, Artificial Sequence
  Synthetic
uguuguuuguuuuugaga

SEQ ID NO: 16458 - RNA, 20 nt, Artificial Sequence
  Synthetic
uguguuguuuguuuuugaga

SEQ ID NO: 16459 - RNA, 21 nt, Artificial Sequence
  Synthetic
uuguguuguuuguuuuugaga

SEQ ID NO: 16460 - RNA, 22 nt, Artificial Sequence
  Synthetic
uuuguguuguuuguuuuugaga

SEQ ID NO: 16461 - RNA, 24 nt, Artificial Sequence
  Synthetic
uguuuguguuguuuguuuuugaga

SEQ ID NO: 16462 - RNA, 21 nt, Artificial Sequence
  Synthetic
uagcuuaaguaaauaaaagga

SEQ ID NO: 16463 - RNA, 22 nt, Artificial Sequence
  Synthetic
cuagcuuaaguaaauaaaagga

SEQ ID NO: 16464 - RNA, 23 nt, Artificial Sequence
  Synthetic
acuagcuuaaguaaauaaaagga

SEQ ID NO: 16465 - RNA, 24 nt, Artificial Sequence
  Synthetic
uacuagcuuaaguaaauaaaagga

SEQ ID NO: 16466 - RNA, 18 nt, Artificial Sequence
  Synthetic
uguugaaugaauccauga

SEQ ID NO: 16467 - RNA, 19 nt, Artificial Sequence
  Synthetic
uuguugaaugaauccauga

SEQ ID NO: 16468 - RNA, 21 nt, Artificial Sequence
  Synthetic
auuuguugaaugaauccauga

SEQ ID NO: 16469 - RNA, 22 nt, Artificial Sequence
  Synthetic
uauuuguugaaugaauccauga

SEQ ID NO: 16470 - RNA, 23 nt, Artificial Sequence
  Synthetic
auauuuguugaaugaauccauga

SEQ ID NO: 16471 - RNA, 24 nt, Artificial Sequence
  Synthetic
aauauuuguugaaugaauccauga

SEQ ID NO: 16472 - RNA, 18 nt, Artificial Sequence
  Synthetic
ucaauaaauauuuguuga

SEQ ID NO: 16473 - RNA, 19 nt, Artificial Sequence
  Synthetic
cucaauaaauauuuguuga

SEQ ID NO: 16474 - RNA, 20 nt, Artificial Sequence
  Synthetic
acucaauaaauauuuguuga

SEQ ID NO: 16475 - RNA, 21 nt, Artificial Sequence
  Synthetic
uacucaauaaauauuuguuga

SEQ ID NO: 16476 - RNA, 22 nt, Artificial Sequence
  Synthetic
auacucaauaaauauuuguuga

SEQ ID NO: 16477 - RNA, 23 nt, Artificial Sequence
  Synthetic
uauacucaauaaauauuuguuga

SEQ ID NO: 16478 - RNA, 24 nt, Artificial Sequence
  Synthetic
auauacucaauaaauauuuguuga

SEQ ID NO: 16479 - RNA, 18 nt, Artificial Sequence
  Synthetic
uuuguuuuuuauuuuuua

SEQ ID NO: 16480 - RNA, 19 nt, Artificial Sequence
  Synthetic
uuuuguuuuuuauuuuuua

SEQ ID NO: 16481 - RNA, 21 nt, Artificial Sequence
  Synthetic
uguuuuguuuuuuauuuuuua

SEQ ID NO: 16482 - RNA, 22 nt, Artificial Sequence
  Synthetic
uuguuuuguuuuuuauuuuuua

SEQ ID NO: 16483 - RNA, 23 nt, Artificial Sequence
  Synthetic
uuuguuuuguuuuuuauuuuuua

SEQ ID NO: 16484 - RNA, 24 nt, Artificial Sequence
  Synthetic
cuuuguuuuguuuuuuauuuuuua

SEQ ID NO: 16485 - RNA, 21 nt, Artificial Sequence
  Synthetic
uaugauguauccccaagugcc

SEQ ID NO: 16486 - RNA, 22 nt, Artificial Sequence
  Synthetic
uuaugauguauccccaagugcc

SEQ ID NO: 16487 - RNA, 23 nt, Artificial Sequence
  Synthetic
uuuaugauguauccccaagugcc

SEQ ID NO: 16488 - RNA, 18 nt, Artificial Sequence
  Synthetic
ucgcugugucacccaggc

SEQ ID NO: 16489 - RNA, 19 nt, Artificial Sequence
  Synthetic
cucgcugugucacccaggc

SEQ ID NO: 16490 - RNA, 22 nt, Artificial Sequence
  Synthetic
agucucgcugugucacccaggc

SEQ ID NO: 16491 - RNA, 24 nt, Artificial Sequence
  Synthetic
agagucucgcugugucacccaggc

SEQ ID NO: 16492 - RNA, 18 nt, Artificial Sequence
  Synthetic
uugcucuguugcccaggc

SEQ ID NO: 16493 - RNA, 19 nt, Artificial Sequence
  Synthetic
cuugcucuguugcccaggc

SEQ ID NO: 16494 - RNA, 22 nt, Artificial Sequence
  Synthetic
agucuugcucuguugcccaggc

SEQ ID NO: 16495 - RNA, 24 nt, Artificial Sequence
  Synthetic
agagucuugcucuguugcccaggc

SEQ ID NO: 16496 - RNA, 18 nt, Artificial Sequence
  Synthetic
cuuggccucccaaaaugc

SEQ ID NO: 16497 - RNA, 19 nt, Artificial Sequence
  Synthetic
ccuuggccucccaaaaugc

SEQ ID NO: 16498 - RNA, 21 nt, Artificial Sequence
  Synthetic
caccuuggccucccaaaaugc

SEQ ID NO: 16499 - RNA, 22 nt, Artificial Sequence
  Synthetic
ccaccuuggccucccaaaaugc

SEQ ID NO: 16500 - RNA, 23 nt, Artificial Sequence
  Synthetic
cccaccuuggccucccaaaaugc

SEQ ID NO: 16501 - RNA, 18 nt, Artificial Sequence
  Synthetic
uucuccugccucagccuc

SEQ ID NO: 16502 - RNA, 19 nt, Artificial Sequence
  Synthetic
auucuccugccucagccuc

SEQ ID NO: 16503 - RNA, 21 nt, Artificial Sequence
  Synthetic
ugauucuccugccucagccuc

SEQ ID NO: 16504 - RNA, 23 nt, Artificial Sequence
  Synthetic
agugauucuccugccucagccuc

SEQ ID NO: 16505 - RNA, 24 nt, Artificial Sequence
  Synthetic
aagugauucuccugccucagccuc

SEQ ID NO: 16506 - RNA, 18 nt, Artificial Sequence
  Synthetic
cacugcaaacucugccuc

SEQ ID NO: 16507 - RNA, 19 nt, Artificial Sequence
  Synthetic
ucacugcaaacucugccuc

SEQ ID NO: 16508 - RNA, 20 nt, Artificial Sequence
  Synthetic
cucacugcaaacucugccuc

SEQ ID NO: 16509 - RNA, 22 nt, Artificial Sequence
  Synthetic
agcucacugcaaacucugccuc

SEQ ID NO: 16510 - RNA, 23 nt, Artificial Sequence
  Synthetic
cagcucacugcaaacucugccuc

SEQ ID NO: 16511 - RNA, 24 nt, Artificial Sequence
  Synthetic
ucagcucacugcaaacucugccuc

SEQ ID NO: 16512 - RNA, 18 nt, Artificial Sequence
  Synthetic
caagcgaaucucagucuc

SEQ ID NO: 16513 - RNA, 19 nt, Artificial Sequence
  Synthetic
ucaagcgaaucucagucuc

SEQ ID NO: 16514 - RNA, 20 nt, Artificial Sequence
  Synthetic
uucaagcgaaucucagucuc

SEQ ID NO: 16515 - RNA, 24 nt, Artificial Sequence
  Synthetic
uggguucaagcgaaucucagucuc

SEQ ID NO: 16516 - RNA, 18 nt, Artificial Sequence
  Synthetic
cacugcaaacuucgucuc

SEQ ID NO: 16517 - RNA, 19 nt, Artificial Sequence
  Synthetic
ucacugcaaacuucgucuc

SEQ ID NO: 16518 - RNA, 20 nt, Artificial Sequence
  Synthetic
cucacugcaaacuucgucuc

SEQ ID NO: 16519 - RNA, 23 nt, Artificial Sequence
  Synthetic
uggcucacugcaaacuucgucuc

SEQ ID NO: 16520 - RNA, 24 nt, Artificial Sequence
  Synthetic
uuggcucacugcaaacuucgucuc

SEQ ID NO: 16521 - RNA, 18 nt, Artificial Sequence
  Synthetic
ucuccuuugauggagaag

SEQ ID NO: 16522 - RNA, 19 nt, Artificial Sequence
  Synthetic
uucuccuuugauggagaag

SEQ ID NO: 16523 - RNA, 20 nt, Artificial Sequence
  Synthetic
uuucuccuuugauggagaag

SEQ ID NO: 16524 - RNA, 18 nt, Artificial Sequence
  Synthetic
auaaaagggugagugaag

SEQ ID NO: 16525 - RNA, 18 nt, Artificial Sequence
  Synthetic
ccucagccucucgaguag

SEQ ID NO: 16526 - RNA, 20 nt, Artificial Sequence
  Synthetic
ugccucagccucucgaguag

SEQ ID NO: 16527 - RNA, 21 nt, Artificial Sequence
  Synthetic
cugccucagccucucgaguag

SEQ ID NO: 16528 - RNA, 22 nt, Artificial Sequence
  Synthetic
ccugccucagccucucgaguag

SEQ ID NO: 16529 - RNA, 23 nt, Artificial Sequence
  Synthetic
uccugccucagccucucgaguag

SEQ ID NO: 16530 - RNA, 24 nt, Artificial Sequence
  Synthetic
cuccugccucagccucucgaguag

SEQ ID NO: 16531 - RNA, 22 nt, Artificial Sequence
  Synthetic
aggccugaugccagauaaaagg

SEQ ID NO: 16532 - RNA, 23 nt, Artificial Sequence
  Synthetic
caggccugaugccagauaaaagg

SEQ ID NO: 16533 - RNA, 24 nt, Artificial Sequence
  Synthetic
acaggccugaugccagauaaaagg

SEQ ID NO: 16534 - RNA, 21 nt, Artificial Sequence
  Synthetic
aaauuuauugaaauauuuugg

SEQ ID NO: 16535 - RNA, 23 nt, Artificial Sequence
  Synthetic
ugaaauuuauugaaauauuuugg

SEQ ID NO: 16536 - RNA, 24 nt, Artificial Sequence
  Synthetic
uugaaauuuauugaaauauuuugg

SEQ ID NO: 16537 - RNA, 18 nt, Artificial Sequence
  Synthetic
uuuguauuuuaguagaug

SEQ ID NO: 16538 - RNA, 19 nt, Artificial Sequence
  Synthetic
uuuuguauuuuaguagaug

SEQ ID NO: 16539 - RNA, 21 nt, Artificial Sequence
  Synthetic
auuuuuguauuuuaguagaug

SEQ ID NO: 16540 - RNA, 22 nt, Artificial Sequence
  Synthetic
aauuuuuguauuuuaguagaug

SEQ ID NO: 16541 - RNA, 23 nt, Artificial Sequence
  Synthetic
uaauuuuuguauuuuaguagaug

SEQ ID NO: 16542 - RNA, 24 nt, Artificial Sequence
  Synthetic
cuaauuuuuguauuuuaguagaug

SEQ ID NO: 16543 - RNA, 22 nt, Artificial Sequence
  Synthetic
agagaacaugaaucugaauuug

SEQ ID NO: 16544 - RNA, 23 nt, Artificial Sequence
  Synthetic
uagagaacaugaaucugaauuug

SEQ ID NO: 16545 - RNA, 24 nt, Artificial Sequence
  Synthetic
auagagaacaugaaucugaauuug

SEQ ID NO: 16546 - RNA, 18 nt, Artificial Sequence
  Synthetic
auacucaauaaauauuug

SEQ ID NO: 16547 - RNA, 19 nt, Artificial Sequence
  Synthetic
uauacucaauaaauauuug

SEQ ID NO: 16548 - RNA, 20 nt, Artificial Sequence
  Synthetic
auauacucaauaaauauuug

SEQ ID NO: 16549 - RNA, 21 nt, Artificial Sequence
  Synthetic
uauauacucaauaaauauuug

SEQ ID NO: 16550 - RNA, 24 nt, Artificial Sequence
  Synthetic
ugguauauacucaauaaauauuug

SEQ ID NO: 16551 - RNA, 22 nt, Artificial Sequence
  Synthetic
uggccagauagagaacaugaau

SEQ ID NO: 16552 - RNA, 23 nt, Artificial Sequence
  Synthetic
auggccagauagagaacaugaau

SEQ ID NO: 16553 - RNA, 24 nt, Artificial Sequence
  Synthetic
uauggccagauagagaacaugaau

SEQ ID NO: 16554 - RNA, 19 nt, Artificial Sequence
  Synthetic
ugcugagggaaugauuaau

SEQ ID NO: 16555 - RNA, 20 nt, Artificial Sequence
  Synthetic
augcugagggaaugauuaau

SEQ ID NO: 16556 - RNA, 21 nt, Artificial Sequence
  Synthetic
uugcuuucaaaaccuuuauau

SEQ ID NO: 16557 - RNA, 22 nt, Artificial Sequence
  Synthetic
uuugcuuucaaaaccuuuauau

SEQ ID NO: 16558 - RNA, 23 nt, Artificial Sequence
  Synthetic
auuugcuuucaaaaccuuuauau

SEQ ID NO: 16559 - RNA, 24 nt, Artificial Sequence
  Synthetic
uauuugcuuucaaaaccuuuauau

SEQ ID NO: 16560 - RNA, 19 nt, Artificial Sequence
  Synthetic
ugagccacuaugcccagcu

SEQ ID NO: 16561 - RNA, 21 nt, Artificial Sequence
  Synthetic
ugugagccacuaugcccagcu

SEQ ID NO: 16562 - RNA, 24 nt, Artificial Sequence
  Synthetic
aggugugagccacuaugcccagcu

SEQ ID NO: 16563 - RNA, 19 nt, Artificial Sequence
  Synthetic
ugugcaaaugccaugaggu

SEQ ID NO: 16564 - RNA, 21 nt, Artificial Sequence
  Synthetic
ugugugcaaaugccaugaggu

SEQ ID NO: 16565 - RNA, 24 nt, Artificial Sequence
  Synthetic
uggugugugcaaaugccaugaggu

SEQ ID NO: 16566 - RNA, 18 nt, Artificial Sequence
  Synthetic
cuuggccucccaaagugu

SEQ ID NO: 16567 - RNA, 19 nt, Artificial Sequence
  Synthetic
ccuuggccucccaaagugu

SEQ ID NO: 16568 - RNA, 21 nt, Artificial Sequence
  Synthetic
cgccuuggccucccaaagugu

SEQ ID NO: 16569 - RNA, 22 nt, Artificial Sequence
  Synthetic
ccgccuuggccucccaaagugu

SEQ ID NO: 16570 - RNA, 23 nt, Artificial Sequence
  Synthetic
cccgccuuggccucccaaagugu

SEQ ID NO: 16571 - RNA, 18 nt, Artificial Sequence
  Synthetic
uguaaaaauuguauauuu

SEQ ID NO: 16572 - RNA, 19 nt, Artificial Sequence
  Synthetic
auguaaaaauuguauauuu

SEQ ID NO: 16573 - RNA, 20 nt, Artificial Sequence
  Synthetic
aauguaaaaauuguauauuu

SEQ ID NO: 16574 - RNA, 21 nt, Artificial Sequence
  Synthetic
aaauguaaaaauuguauauuu

SEQ ID NO: 16575 - RNA, 22 nt, Artificial Sequence
  Synthetic
caaauguaaaaauuguauauuu

SEQ ID NO: 16576 - RNA, 23 nt, Artificial Sequence
  Synthetic
acaaauguaaaaauuguauauuu

SEQ ID NO: 16577 - RNA, 24 nt, Artificial Sequence
  Synthetic
aacaaauguaaaaauuguauauuu

SEQ ID NO: 16578 - RNA, 18 nt, Artificial Sequence
  Synthetic
cuucaaaaugccaaaaaa

SEQ ID NO: 16579 - RNA, 19 nt, Artificial Sequence
  Synthetic
ccuucaaaaugccaaaaaa

SEQ ID NO: 16580 - RNA, 21 nt, Artificial Sequence
  Synthetic
ugccuucaaaaugccaaaaaa

SEQ ID NO: 16581 - RNA, 22 nt, Artificial Sequence
  Synthetic
uugccuucaaaaugccaaaaaa

SEQ ID NO: 16582 - RNA, 23 nt, Artificial Sequence
  Synthetic
uuugccuucaaaaugccaaaaaa

SEQ ID NO: 16583 - RNA, 24 nt, Artificial Sequence
  Synthetic
cuuugccuucaaaaugccaaaaaa

SEQ ID NO: 16584 - RNA, 18 nt, Artificial Sequence
  Synthetic
ccuucaaaaugccaaaaa

SEQ ID NO: 16585 - RNA, 19 nt, Artificial Sequence
  Synthetic
gccuucaaaaugccaaaaa

SEQ ID NO: 16586 - RNA, 20 nt, Artificial Sequence
  Synthetic
ugccuucaaaaugccaaaaa

SEQ ID NO: 16587 - RNA, 21 nt, Artificial Sequence
  Synthetic
uugccuucaaaaugccaaaaa

SEQ ID NO: 16588 - RNA, 22 nt, Artificial Sequence
  Synthetic
uuugccuucaaaaugccaaaaa

SEQ ID NO: 16589 - RNA, 23 nt, Artificial Sequence
  Synthetic
cuuugccuucaaaaugccaaaaa

SEQ ID NO: 16590 - RNA, 24 nt, Artificial Sequence
  Synthetic
acuuugccuucaaaaugccaaaaa

SEQ ID NO: 16591 - RNA, 18 nt, Artificial Sequence
  Synthetic
caauccauggucacaaaa

SEQ ID NO: 16592 - RNA, 19 nt, Artificial Sequence
  Synthetic
ucaauccauggucacaaaa

SEQ ID NO: 16593 - RNA, 20 nt, Artificial Sequence
  Synthetic
uucaauccauggucacaaaa

SEQ ID NO: 16594 - RNA, 21 nt, Artificial Sequence
  Synthetic
auucaauccauggucacaaaa

SEQ ID NO: 16595 - RNA, 22 nt, Artificial Sequence
  Synthetic
gauucaauccauggucacaaaa

SEQ ID NO: 16596 - RNA, 23 nt, Artificial Sequence
  Synthetic
ggauucaauccauggucacaaaa

SEQ ID NO: 16597 - RNA, 24 nt, Artificial Sequence
  Synthetic
aggauucaauccauggucacaaaa

SEQ ID NO: 16598 - RNA, 18 nt, Artificial Sequence
  Synthetic
ugggggauacagugaaaa

SEQ ID NO: 16599 - RNA, 19 nt, Artificial Sequence
  Synthetic
augggggauacagugaaaa

SEQ ID NO: 16600 - RNA, 20 nt, Artificial Sequence
  Synthetic
caugggggauacagugaaaa

SEQ ID NO: 16601 - RNA, 21 nt, Artificial Sequence
  Synthetic
acaugggggauacagugaaaa

SEQ ID NO: 16602 - RNA, 22 nt, Artificial Sequence
  Synthetic
aacaugggggauacagugaaaa

SEQ ID NO: 16603 - RNA, 23 nt, Artificial Sequence
  Synthetic
caacaugggggauacagugaaaa

SEQ ID NO: 16604 - RNA, 24 nt, Artificial Sequence
  Synthetic
ucaacaugggggauacagugaaaa

SEQ ID NO: 16605 - RNA, 18 nt, Artificial Sequence
  Synthetic
auuaaaggucuuugaaaa

SEQ ID NO: 16606 - RNA, 19 nt, Artificial Sequence
  Synthetic
uauuaaaggucuuugaaaa

SEQ ID NO: 16607 - RNA, 20 nt, Artificial Sequence
  Synthetic
guauuaaaggucuuugaaaa

SEQ ID NO: 16608 - RNA, 21 nt, Artificial Sequence
  Synthetic
uguauuaaaggucuuugaaaa

SEQ ID NO: 16609 - RNA, 22 nt, Artificial Sequence
  Synthetic
auguauuaaaggucuuugaaaa

SEQ ID NO: 16610 - RNA, 23 nt, Artificial Sequence
  Synthetic
cauguauuaaaggucuuugaaaa

SEQ ID NO: 16611 - RNA, 24 nt, Artificial Sequence
  Synthetic
ucauguauuaaaggucuuugaaaa

SEQ ID NO: 16612 - RNA, 18 nt, Artificial Sequence
  Synthetic
guuugcuuuucuguaaaa

SEQ ID NO: 16613 - RNA, 19 nt, Artificial Sequence
  Synthetic
aguuugcuuuucuguaaaa

SEQ ID NO: 16614 - RNA, 20 nt, Artificial Sequence
  Synthetic
caguuugcuuuucuguaaaa

SEQ ID NO: 16615 - RNA, 21 nt, Artificial Sequence
  Synthetic
ucaguuugcuuuucuguaaaa

SEQ ID NO: 16616 - RNA, 22 nt, Artificial Sequence
  Synthetic
cucaguuugcuuuucuguaaaa

SEQ ID NO: 16617 - RNA, 23 nt, Artificial Sequence
  Synthetic
ccucaguuugcuuuucuguaaaa

SEQ ID NO: 16618 - RNA, 24 nt, Artificial Sequence
  Synthetic
gccucaguuugcuuuucuguaaaa

SEQ ID NO: 16619 - RNA, 18 nt, Artificial Sequence
  Synthetic
uuuugauuggaaaggaaa

SEQ ID NO: 16620 - RNA, 19 nt, Artificial Sequence
  Synthetic
cuuuugauuggaaaggaaa

SEQ ID NO: 16621 - RNA, 20 nt, Artificial Sequence
  Synthetic
ccuuuugauuggaaaggaaa

SEQ ID NO: 16622 - RNA, 21 nt, Artificial Sequence
  Synthetic
accuuuugauuggaaaggaaa

SEQ ID NO: 16623 - RNA, 22 nt, Artificial Sequence
  Synthetic
aaccuuuugauuggaaaggaaa

SEQ ID NO: 16624 - RNA, 23 nt, Artificial Sequence
  Synthetic
uaaccuuuugauuggaaaggaaa

SEQ ID NO: 16625 - RNA, 24 nt, Artificial Sequence
  Synthetic
cuaaccuuuugauuggaaaggaaa

SEQ ID NO: 16626 - RNA, 18 nt, Artificial Sequence
  Synthetic
gcugagauguaaaugaaa

SEQ ID NO: 16627 - RNA, 19 nt, Artificial Sequence
  Synthetic
agcugagauguaaaugaaa

SEQ ID NO: 16628 - RNA, 20 nt, Artificial Sequence
  Synthetic
gagcugagauguaaaugaaa

SEQ ID NO: 16629 - RNA, 21 nt, Artificial Sequence
  Synthetic
ggagcugagauguaaaugaaa

SEQ ID NO: 16630 - RNA, 22 nt, Artificial Sequence
  Synthetic
aggagcugagauguaaaugaaa

SEQ ID NO: 16631 - RNA, 23 nt, Artificial Sequence
  Synthetic
caggagcugagauguaaaugaaa

SEQ ID NO: 16632 - RNA, 24 nt, Artificial Sequence
  Synthetic
ucaggagcugagauguaaaugaaa

SEQ ID NO: 16633 - RNA, 18 nt, Artificial Sequence
  Synthetic
gggauacaucauaaacaa

SEQ ID NO: 16634 - RNA, 19 nt, Artificial Sequence
  Synthetic
ggggauacaucauaaacaa

SEQ ID NO: 16635 - RNA, 20 nt, Artificial Sequence
  Synthetic
uggggauacaucauaaacaa

SEQ ID NO: 16636 - RNA, 21 nt, Artificial Sequence
  Synthetic
uuggggauacaucauaaacaa

SEQ ID NO: 16637 - RNA, 22 nt, Artificial Sequence
  Synthetic
cuuggggauacaucauaaacaa

SEQ ID NO: 16638 - RNA, 23 nt, Artificial Sequence
  Synthetic
acuuggggauacaucauaaacaa

SEQ ID NO: 16639 - RNA, 24 nt, Artificial Sequence
  Synthetic
cacuuggggauacaucauaaacaa

SEQ ID NO: 16640 - RNA, 18 nt, Artificial Sequence
  Synthetic
acacuccagccugggcaa

SEQ ID NO: 16641 - RNA, 19 nt, Artificial Sequence
  Synthetic
uacacuccagccugggcaa

SEQ ID NO: 16642 - RNA, 20 nt, Artificial Sequence
  Synthetic
uuacacuccagccugggcaa

SEQ ID NO: 16643 - RNA, 21 nt, Artificial Sequence
  Synthetic
auuacacuccagccugggcaa

SEQ ID NO: 16644 - RNA, 22 nt, Artificial Sequence
  Synthetic
cauuacacuccagccugggcaa

SEQ ID NO: 16645 - RNA, 23 nt, Artificial Sequence
  Synthetic
ccauuacacuccagccugggcaa

SEQ ID NO: 16646 - RNA, 24 nt, Artificial Sequence
  Synthetic
accauuacacuccagccugggcaa

SEQ ID NO: 16647 - RNA, 18 nt, Artificial Sequence
  Synthetic
acucaccuucuccaucaa

SEQ ID NO: 16648 - RNA, 19 nt, Artificial Sequence
  Synthetic
gacucaccuucuccaucaa

SEQ ID NO: 16649 - RNA, 21 nt, Artificial Sequence
  Synthetic
cagacucaccuucuccaucaa

SEQ ID NO: 16650 - RNA, 22 nt, Artificial Sequence
  Synthetic
gcagacucaccuucuccaucaa

SEQ ID NO: 16651 - RNA, 23 nt, Artificial Sequence
  Synthetic
agcagacucaccuucuccaucaa

SEQ ID NO: 16652 - RNA, 24 nt, Artificial Sequence
  Synthetic
gagcagacucaccuucuccaucaa

SEQ ID NO: 16653 - RNA, 18 nt, Artificial Sequence
  Synthetic
auaccaauuuuauaagaa

SEQ ID NO: 16654 - RNA, 19 nt, Artificial Sequence
  Synthetic
aauaccaauuuuauaagaa

SEQ ID NO: 16655 - RNA, 20 nt, Artificial Sequence
  Synthetic
aaauaccaauuuuauaagaa

SEQ ID NO: 16656 - RNA, 21 nt, Artificial Sequence
  Synthetic
caaauaccaauuuuauaagaa

SEQ ID NO: 16657 - RNA, 22 nt, Artificial Sequence
  Synthetic
ucaaauaccaauuuuauaagaa

SEQ ID NO: 16658 - RNA, 23 nt, Artificial Sequence
  Synthetic
uucaaauaccaauuuuauaagaa

SEQ ID NO: 16659 - RNA, 24 nt, Artificial Sequence
  Synthetic
uuucaaauaccaauuuuauaagaa

SEQ ID NO: 16660 - RNA, 18 nt, Artificial Sequence
  Synthetic
accaggcccagaucagaa

SEQ ID NO: 16661 - RNA, 19 nt, Artificial Sequence
  Synthetic
uaccaggcccagaucagaa

SEQ ID NO: 16662 - RNA, 21 nt, Artificial Sequence
  Synthetic
cauaccaggcccagaucagaa

SEQ ID NO: 16663 - RNA, 22 nt, Artificial Sequence
  Synthetic
acauaccaggcccagaucagaa

SEQ ID NO: 16664 - RNA, 23 nt, Artificial Sequence
  Synthetic
cacauaccaggcccagaucagaa

SEQ ID NO: 16665 - RNA, 24 nt, Artificial Sequence
  Synthetic
ccacauaccaggcccagaucagaa

SEQ ID NO: 16666 - RNA, 18 nt, Artificial Sequence
  Synthetic
cuaaccuuuugauuggaa

SEQ ID NO: 16667 - RNA, 19 nt, Artificial Sequence
  Synthetic
ccuaaccuuuugauuggaa

SEQ ID NO: 16668 - RNA, 21 nt, Artificial Sequence
  Synthetic
auccuaaccuuuugauuggaa

SEQ ID NO: 16669 - RNA, 22 nt, Artificial Sequence
  Synthetic
gauccuaaccuuuugauuggaa

SEQ ID NO: 16670 - RNA, 23 nt, Artificial Sequence
  Synthetic
ggauccuaaccuuuugauuggaa

SEQ ID NO: 16671 - RNA, 24 nt, Artificial Sequence
  Synthetic
aggauccuaaccuuuugauuggaa

SEQ ID NO: 16672 - RNA, 18 nt, Artificial Sequence
  Synthetic
uggcauagcauuguugaa

SEQ ID NO: 16673 - RNA, 19 nt, Artificial Sequence
  Synthetic
cuggcauagcauuguugaa

SEQ ID NO: 16674 - RNA, 20 nt, Artificial Sequence
  Synthetic
acuggcauagcauuguugaa

SEQ ID NO: 16675 - RNA, 21 nt, Artificial Sequence
  Synthetic
uacuggcauagcauuguugaa

SEQ ID NO: 16676 - RNA, 22 nt, Artificial Sequence
  Synthetic
guacuggcauagcauuguugaa

SEQ ID NO: 16677 - RNA, 23 nt, Artificial Sequence
  Synthetic
uguacuggcauagcauuguugaa

SEQ ID NO: 16678 - RNA, 24 nt, Artificial Sequence
  Synthetic
uuguacuggcauagcauuguugaa

SEQ ID NO: 16679 - RNA, 18 nt, Artificial Sequence
  Synthetic
aaaacaaaacaaaaauaa

SEQ ID NO: 16680 - RNA, 19 nt, Artificial Sequence
  Synthetic
caaaacaaaacaaaaauaa

SEQ ID NO: 16681 - RNA, 20 nt, Artificial Sequence
  Synthetic
acaaaacaaaacaaaaauaa

SEQ ID NO: 16682 - RNA, 21 nt, Artificial Sequence
  Synthetic
aacaaaacaaaacaaaaauaa

SEQ ID NO: 16683 - RNA, 22 nt, Artificial Sequence
  Synthetic
aaacaaaacaaaacaaaaauaa

SEQ ID NO: 16684 - RNA, 23 nt, Artificial Sequence
  Synthetic
aaaacaaaacaaaacaaaaauaa

SEQ ID NO: 16685 - RNA, 24 nt, Artificial Sequence
  Synthetic
aaaaacaaaacaaaacaaaaauaa

SEQ ID NO: 16686 - RNA, 18 nt, Artificial Sequence
  Synthetic
acaccaaguguucaauaa

SEQ ID NO: 16687 - RNA, 19 nt, Artificial Sequence
  Synthetic
cacaccaaguguucaauaa

SEQ ID NO: 16688 - RNA, 20 nt, Artificial Sequence
  Synthetic
acacaccaaguguucaauaa

SEQ ID NO: 16689 - RNA, 21 nt, Artificial Sequence
  Synthetic
cacacaccaaguguucaauaa

SEQ ID NO: 16690 - RNA, 22 nt, Artificial Sequence
  Synthetic
gcacacaccaaguguucaauaa

SEQ ID NO: 16691 - RNA, 23 nt, Artificial Sequence
  Synthetic
ugcacacaccaaguguucaauaa

SEQ ID NO: 16692 - RNA, 24 nt, Artificial Sequence
  Synthetic
uugcacacaccaaguguucaauaa

SEQ ID NO: 16693 - RNA, 18 nt, Artificial Sequence
  Synthetic
ucaggagcugagauguaa

SEQ ID NO: 16694 - RNA, 19 nt, Artificial Sequence
  Synthetic
uucaggagcugagauguaa

SEQ ID NO: 16695 - RNA, 20 nt, Artificial Sequence
  Synthetic
cuucaggagcugagauguaa

SEQ ID NO: 16696 - RNA, 21 nt, Artificial Sequence
  Synthetic
acuucaggagcugagauguaa

SEQ ID NO: 16697 - RNA, 22 nt, Artificial Sequence
  Synthetic
uacuucaggagcugagauguaa

SEQ ID NO: 16698 - RNA, 23 nt, Artificial Sequence
  Synthetic
auacuucaggagcugagauguaa

SEQ ID NO: 16699 - RNA, 24 nt, Artificial Sequence
  Synthetic
cauacuucaggagcugagauguaa

SEQ ID NO: 16700 - RNA, 18 nt, Artificial Sequence
  Synthetic
ggaaaugaauuuaauuaa

SEQ ID NO: 16701 - RNA, 19 nt, Artificial Sequence
  Synthetic
aggaaaugaauuuaauuaa

SEQ ID NO: 16702 - RNA, 20 nt, Artificial Sequence
  Synthetic
aaggaaaugaauuuaauuaa

SEQ ID NO: 16703 - RNA, 21 nt, Artificial Sequence
  Synthetic
aaaggaaaugaauuuaauuaa

SEQ ID NO: 16704 - RNA, 22 nt, Artificial Sequence
  Synthetic
aaaaggaaaugaauuuaauuaa

SEQ ID NO: 16705 - RNA, 23 nt, Artificial Sequence
  Synthetic
aaaaaggaaaugaauuuaauuaa

SEQ ID NO: 16706 - RNA, 24 nt, Artificial Sequence
  Synthetic
aaaaaaggaaaugaauuuaauuaa

SEQ ID NO: 16707 - RNA, 18 nt, Artificial Sequence
  Synthetic
uuuuaaauugaaucaaca

SEQ ID NO: 16708 - RNA, 19 nt, Artificial Sequence
  Synthetic
uuuuuaaauugaaucaaca

SEQ ID NO: 16709 - RNA, 21 nt, Artificial Sequence
  Synthetic
auuuuuuaaauugaaucaaca

SEQ ID NO: 16710 - RNA, 22 nt, Artificial Sequence
  Synthetic
uauuuuuuaaauugaaucaaca

SEQ ID NO: 16711 - RNA, 23 nt, Artificial Sequence
  Synthetic
auauuuuuuaaauugaaucaaca

SEQ ID NO: 16712 - RNA, 24 nt, Artificial Sequence
  Synthetic
uauauuuuuuaaauugaaucaaca

SEQ ID NO: 16713 - RNA, 18 nt, Artificial Sequence
  Synthetic
ccaccuuucucucacaca

SEQ ID NO: 16714 - RNA, 19 nt, Artificial Sequence
  Synthetic
uccaccuuucucucacaca

SEQ ID NO: 16715 - RNA, 20 nt, Artificial Sequence
  Synthetic
cuccaccuuucucucacaca

SEQ ID NO: 16716 - RNA, 21 nt, Artificial Sequence
  Synthetic
ucuccaccuuucucucacaca

SEQ ID NO: 16717 - RNA, 22 nt, Artificial Sequence
  Synthetic
uucuccaccuuucucucacaca

SEQ ID NO: 16718 - RNA, 23 nt, Artificial Sequence
  Synthetic
cuucuccaccuuucucucacaca

SEQ ID NO: 16719 - RNA, 24 nt, Artificial Sequence
  Synthetic
gcuucuccaccuuucucucacaca

SEQ ID NO: 16720 - RNA, 18 nt, Artificial Sequence
  Synthetic
uccagccugggugacaca

SEQ ID NO: 16721 - RNA, 19 nt, Artificial Sequence
  Synthetic
cuccagccugggugacaca

SEQ ID NO: 16722 - RNA, 20 nt, Artificial Sequence
  Synthetic
acuccagccugggugacaca

SEQ ID NO: 16723 - RNA, 21 nt, Artificial Sequence
  Synthetic
cacuccagccugggugacaca

SEQ ID NO: 16724 - RNA, 22 nt, Artificial Sequence
  Synthetic
acacuccagccugggugacaca

SEQ ID NO: 16725 - RNA, 23 nt, Artificial Sequence
  Synthetic
uacacuccagccugggugacaca

SEQ ID NO: 16726 - RNA, 24 nt, Artificial Sequence
  Synthetic
cuacacuccagccugggugacaca

SEQ ID NO: 16727 - RNA, 18 nt, Artificial Sequence
  Synthetic
aaaauuucaugaaccaca

SEQ ID NO: 16728 - RNA, 19 nt, Artificial Sequence
  Synthetic
aaaaauuucaugaaccaca

SEQ ID NO: 16729 - RNA, 21 nt, Artificial Sequence
  Synthetic
ugaaaaauuucaugaaccaca

SEQ ID NO: 16730 - RNA, 22 nt, Artificial Sequence
  Synthetic
augaaaaauuucaugaaccaca

SEQ ID NO: 16731 - RNA, 23 nt, Artificial Sequence
  Synthetic
gaugaaaaauuucaugaaccaca

SEQ ID NO: 16732 - RNA, 24 nt, Artificial Sequence
  Synthetic
agaugaaaaauuucaugaaccaca

SEQ ID NO: 16733 - RNA, 18 nt, Artificial Sequence
  Synthetic
gugaaaaagugguccaca

SEQ ID NO: 16734 - RNA, 19 nt, Artificial Sequence
  Synthetic
ugugaaaaagugguccaca

SEQ ID NO: 16735 - RNA, 21 nt, Artificial Sequence
  Synthetic
aaugugaaaaagugguccaca

SEQ ID NO: 16736 - RNA, 22 nt, Artificial Sequence
  Synthetic
caaugugaaaaagugguccaca

SEQ ID NO: 16737 - RNA, 23 nt, Artificial Sequence
  Synthetic
ucaaugugaaaaagugguccaca

SEQ ID NO: 16738 - RNA, 24 nt, Artificial Sequence
  Synthetic
uucaaugugaaaaagugguccaca

SEQ ID NO: 16739 - RNA, 18 nt, Artificial Sequence
  Synthetic
gccuuuuuucucuucaca

SEQ ID NO: 16740 - RNA, 19 nt, Artificial Sequence
  Synthetic
agccuuuuuucucuucaca

SEQ ID NO: 16741 - RNA, 20 nt, Artificial Sequence
  Synthetic
aagccuuuuuucucuucaca

SEQ ID NO: 16742 - RNA, 21 nt, Artificial Sequence
  Synthetic
aaagccuuuuuucucuucaca

SEQ ID NO: 16743 - RNA, 22 nt, Artificial Sequence
  Synthetic
gaaagccuuuuuucucuucaca

SEQ ID NO: 16744 - RNA, 23 nt, Artificial Sequence
  Synthetic
ugaaagccuuuuuucucuucaca

SEQ ID NO: 16745 - RNA, 24 nt, Artificial Sequence
  Synthetic
augaaagccuuuuuucucuucaca

SEQ ID NO: 16746 - RNA, 18 nt, Artificial Sequence
  Synthetic
cacauuuagccaaggaca

SEQ ID NO: 16747 - RNA, 19 nt, Artificial Sequence
  Synthetic
ucacauuuagccaaggaca

SEQ ID NO: 16748 - RNA, 20 nt, Artificial Sequence
  Synthetic
uucacauuuagccaaggaca

SEQ ID NO: 16749 - RNA, 21 nt, Artificial Sequence
  Synthetic
uuucacauuuagccaaggaca

SEQ ID NO: 16750 - RNA, 22 nt, Artificial Sequence
  Synthetic
uuuucacauuuagccaaggaca

SEQ ID NO: 16751 - RNA, 23 nt, Artificial Sequence
  Synthetic
uuuuucacauuuagccaaggaca

SEQ ID NO: 16752 - RNA, 24 nt, Artificial Sequence
  Synthetic
auuuuucacauuuagccaaggaca

SEQ ID NO: 16753 - RNA, 18 nt, Artificial Sequence
  Synthetic
aucaacaugggggauaca

SEQ ID NO: 16754 - RNA, 19 nt, Artificial Sequence
  Synthetic
aaucaacaugggggauaca

SEQ ID NO: 16755 - RNA, 20 nt, Artificial Sequence
  Synthetic
gaaucaacaugggggauaca

SEQ ID NO: 16756 - RNA, 21 nt, Artificial Sequence
  Synthetic
ugaaucaacaugggggauaca

SEQ ID NO: 16757 - RNA, 22 nt, Artificial Sequence
  Synthetic
uugaaucaacaugggggauaca

SEQ ID NO: 16758 - RNA, 23 nt, Artificial Sequence
  Synthetic
auugaaucaacaugggggauaca

SEQ ID NO: 16759 - RNA, 24 nt, Artificial Sequence
  Synthetic
aauugaaucaacaugggggauaca

SEQ ID NO: 16760 - RNA, 18 nt, Artificial Sequence
  Synthetic
gaucagaugggaaagcca

SEQ ID NO: 16761 - RNA, 19 nt, Artificial Sequence
  Synthetic
ggaucagaugggaaagcca

SEQ ID NO: 16762 - RNA, 21 nt, Artificial Sequence
  Synthetic
auggaucagaugggaaagcca

SEQ ID NO: 16763 - RNA, 22 nt, Artificial Sequence
  Synthetic
aauggaucagaugggaaagcca

SEQ ID NO: 16764 - RNA, 23 nt, Artificial Sequence
  Synthetic
aaauggaucagaugggaaagcca

SEQ ID NO: 16765 - RNA, 24 nt, Artificial Sequence
  Synthetic
gaaauggaucagaugggaaagcca

SEQ ID NO: 16766 - RNA, 18 nt, Artificial Sequence
  Synthetic
caggagacgaaguuugca

SEQ ID NO: 16767 - RNA, 19 nt, Artificial Sequence
  Synthetic
ccaggagacgaaguuugca

SEQ ID NO: 16768 - RNA, 20 nt, Artificial Sequence
  Synthetic
cccaggagacgaaguuugca

SEQ ID NO: 16769 - RNA, 21 nt, Artificial Sequence
  Synthetic
acccaggagacgaaguuugca

SEQ ID NO: 16770 - RNA, 22 nt, Artificial Sequence
  Synthetic
aacccaggagacgaaguuugca

SEQ ID NO: 16771 - RNA, 23 nt, Artificial Sequence
  Synthetic
gaacccaggagacgaaguuugca

SEQ ID NO: 16772 - RNA, 24 nt, Artificial Sequence
  Synthetic
ugaacccaggagacgaaguuugca

SEQ ID NO: 16773 - RNA, 18 nt, Artificial Sequence
  Synthetic
caggaggcagaguuugca

SEQ ID NO: 16774 - RNA, 19 nt, Artificial Sequence
  Synthetic
ccaggaggcagaguuugca

SEQ ID NO: 16775 - RNA, 20 nt, Artificial Sequence
  Synthetic
cccaggaggcagaguuugca

SEQ ID NO: 16776 - RNA, 21 nt, Artificial Sequence
  Synthetic
acccaggaggcagaguuugca

SEQ ID NO: 16777 - RNA, 22 nt, Artificial Sequence
  Synthetic
aacccaggaggcagaguuugca

SEQ ID NO: 16778 - RNA, 23 nt, Artificial Sequence
  Synthetic
gaacccaggaggcagaguuugca

SEQ ID NO: 16779 - RNA, 24 nt, Artificial Sequence
  Synthetic
ugaacccaggaggcagaguuugca

SEQ ID NO: 16780 - RNA, 18 nt, Artificial Sequence
  Synthetic
gacucaccuucuccauca

SEQ ID NO: 16781 - RNA, 19 nt, Artificial Sequence
  Synthetic
agacucaccuucuccauca

SEQ ID NO: 16782 - RNA, 20 nt, Artificial Sequence
  Synthetic
cagacucaccuucuccauca

SEQ ID NO: 16783 - RNA, 21 nt, Artificial Sequence
  Synthetic
gcagacucaccuucuccauca

SEQ ID NO: 16784 - RNA, 22 nt, Artificial Sequence
  Synthetic
agcagacucaccuucuccauca

SEQ ID NO: 16785 - RNA, 23 nt, Artificial Sequence
  Synthetic
gagcagacucaccuucuccauca

SEQ ID NO: 16786 - RNA, 24 nt, Artificial Sequence
  Synthetic
ggagcagacucaccuucuccauca

SEQ ID NO: 16787 - RNA, 18 nt, Artificial Sequence
  Synthetic
uuucgugguccuuaaaga

SEQ ID NO: 16788 - RNA, 19 nt, Artificial Sequence
  Synthetic
cuuucgugguccuuaaaga

SEQ ID NO: 16789 - RNA, 20 nt, Artificial Sequence
  Synthetic
ucuuucgugguccuuaaaga

SEQ ID NO: 16790 - RNA, 21 nt, Artificial Sequence
  Synthetic
uucuuucgugguccuuaaaga

SEQ ID NO: 16791 - RNA, 22 nt, Artificial Sequence
  Synthetic
cuucuuucgugguccuuaaaga

SEQ ID NO: 16792 - RNA, 23 nt, Artificial Sequence
  Synthetic
ccuucuuucgugguccuuaaaga

SEQ ID NO: 16793 - RNA, 24 nt, Artificial Sequence
  Synthetic
uccuucuuucgugguccuuaaaga

SEQ ID NO: 16794 - RNA, 18 nt, Artificial Sequence
  Synthetic
uaccaggcccagaucaga

SEQ ID NO: 16795 - RNA, 19 nt, Artificial Sequence
  Synthetic
auaccaggcccagaucaga

SEQ ID NO: 16796 - RNA, 21 nt, Artificial Sequence
  Synthetic
acauaccaggcccagaucaga

SEQ ID NO: 16797 - RNA, 22 nt, Artificial Sequence
  Synthetic
cacauaccaggcccagaucaga

SEQ ID NO: 16798 - RNA, 23 nt, Artificial Sequence
  Synthetic
ccacauaccaggcccagaucaga

SEQ ID NO: 16799 - RNA, 24 nt, Artificial Sequence
  Synthetic
accacauaccaggcccagaucaga

SEQ ID NO: 16800 - RNA, 18 nt, Artificial Sequence
  Synthetic
aaggagaaauggaucaga

SEQ ID NO: 16801 - RNA, 19 nt, Artificial Sequence
  Synthetic
aaaggagaaauggaucaga

SEQ ID NO: 16802 - RNA, 21 nt, Artificial Sequence
  Synthetic
ucaaaggagaaauggaucaga

SEQ ID NO: 16803 - RNA, 22 nt, Artificial Sequence
  Synthetic
aucaaaggagaaauggaucaga

SEQ ID NO: 16804 - RNA, 23 nt, Artificial Sequence
  Synthetic
caucaaaggagaaauggaucaga

SEQ ID NO: 16805 - RNA, 24 nt, Artificial Sequence
  Synthetic
ccaucaaaggagaaauggaucaga

SEQ ID NO: 16806 - RNA, 18 nt, Artificial Sequence
  Synthetic
caucauaaacaaaagaga

SEQ ID NO: 16807 - RNA, 19 nt, Artificial Sequence
  Synthetic
acaucauaaacaaaagaga

SEQ ID NO: 16808 - RNA, 20 nt, Artificial Sequence
  Synthetic
uacaucauaaacaaaagaga

SEQ ID NO: 16809 - RNA, 21 nt, Artificial Sequence
  Synthetic
auacaucauaaacaaaagaga

SEQ ID NO: 16810 - RNA, 22 nt, Artificial Sequence
  Synthetic
gauacaucauaaacaaaagaga

SEQ ID NO: 16811 - RNA, 23 nt, Artificial Sequence
  Synthetic
ggauacaucauaaacaaaagaga

SEQ ID NO: 16812 - RNA, 24 nt, Artificial Sequence
  Synthetic
gggauacaucauaaacaaaagaga

SEQ ID NO: 16813 - RNA, 18 nt, Artificial Sequence
  Synthetic
ucccagcuacucaggaga

SEQ ID NO: 16814 - RNA, 19 nt, Artificial Sequence
  Synthetic
gucccagcuacucaggaga

SEQ ID NO: 16815 - RNA, 20 nt, Artificial Sequence
  Synthetic
agucccagcuacucaggaga

SEQ ID NO: 16816 - RNA, 21 nt, Artificial Sequence
  Synthetic
uagucccagcuacucaggaga

SEQ ID NO: 16817 - RNA, 22 nt, Artificial Sequence
  Synthetic
guagucccagcuacucaggaga

SEQ ID NO: 16818 - RNA, 23 nt, Artificial Sequence
  Synthetic
uguagucccagcuacucaggaga

SEQ ID NO: 16819 - RNA, 24 nt, Artificial Sequence
  Synthetic
cuguagucccagcuacucaggaga

SEQ ID NO: 16820 - RNA, 18 nt, Artificial Sequence
  Synthetic
uaugaaagaaaaaauaga

SEQ ID NO: 16821 - RNA, 19 nt, Artificial Sequence
  Synthetic
cuaugaaagaaaaaauaga

SEQ ID NO: 16822 - RNA, 20 nt, Artificial Sequence
  Synthetic
gcuaugaaagaaaaaauaga

SEQ ID NO: 16823 - RNA, 21 nt, Artificial Sequence
  Synthetic
agcuaugaaagaaaaaauaga

SEQ ID NO: 16824 - RNA, 22 nt, Artificial Sequence
  Synthetic
uagcuaugaaagaaaaaauaga

SEQ ID NO: 16825 - RNA, 23 nt, Artificial Sequence
  Synthetic
uuagcuaugaaagaaaaaauaga

SEQ ID NO: 16826 - RNA, 24 nt, Artificial Sequence
  Synthetic
guuagcuaugaaagaaaaaauaga

SEQ ID NO: 16827 - RNA, 18 nt, Artificial Sequence
  Synthetic
gauacagugaaaacugga

SEQ ID NO: 16828 - RNA, 19 nt, Artificial Sequence
  Synthetic
ggauacagugaaaacugga

SEQ ID NO: 16829 - RNA, 20 nt, Artificial Sequence
  Synthetic
gggauacagugaaaacugga

SEQ ID NO: 16830 - RNA, 21 nt, Artificial Sequence
  Synthetic
ggggauacagugaaaacugga

SEQ ID NO: 16831 - RNA, 22 nt, Artificial Sequence
  Synthetic
gggggauacagugaaaacugga

SEQ ID NO: 16832 - RNA, 23 nt, Artificial Sequence
  Synthetic
ugggggauacagugaaaacugga

SEQ ID NO: 16833 - RNA, 24 nt, Artificial Sequence
  Synthetic
augggggauacagugaaaacugga

SEQ ID NO: 16834 - RNA, 18 nt, Artificial Sequence
  Synthetic
ccuaaccuuuugauugga

SEQ ID NO: 16835 - RNA, 19 nt, Artificial Sequence
  Synthetic
uccuaaccuuuugauugga

SEQ ID NO: 16836 - RNA, 20 nt, Artificial Sequence
  Synthetic
auccuaaccuuuugauugga

SEQ ID NO: 16837 - RNA, 21 nt, Artificial Sequence
  Synthetic
gauccuaaccuuuugauugga

SEQ ID NO: 16838 - RNA, 22 nt, Artificial Sequence
  Synthetic
ggauccuaaccuuuugauugga

SEQ ID NO: 16839 - RNA, 23 nt, Artificial Sequence
  Synthetic
aggauccuaaccuuuugauugga

SEQ ID NO: 16840 - RNA, 24 nt, Artificial Sequence
  Synthetic
aaggauccuaaccuuuugauugga

SEQ ID NO: 16841 - RNA, 18 nt, Artificial Sequence
  Synthetic
agagaauguuagcuauga

SEQ ID NO: 16842 - RNA, 19 nt, Artificial Sequence
  Synthetic
cagagaauguuagcuauga

SEQ ID NO: 16843 - RNA, 20 nt, Artificial Sequence
  Synthetic
gcagagaauguuagcuauga

SEQ ID NO: 16844 - RNA, 21 nt, Artificial Sequence
  Synthetic
agcagagaauguuagcuauga

SEQ ID NO: 16845 - RNA, 22 nt, Artificial Sequence
  Synthetic
gagcagagaauguuagcuauga

SEQ ID NO: 16846 - RNA, 23 nt, Artificial Sequence
  Synthetic
agagcagagaauguuagcuauga

SEQ ID NO: 16847 - RNA, 24 nt, Artificial Sequence
  Synthetic
gagagcagagaauguuagcuauga

SEQ ID NO: 16848 - RNA, 18 nt, Artificial Sequence
  Synthetic
uccacucagaguggcuga

SEQ ID NO: 16849 - RNA, 19 nt, Artificial Sequence
  Synthetic
uuccacucagaguggcuga

SEQ ID NO: 16850 - RNA, 20 nt, Artificial Sequence
  Synthetic
uuuccacucagaguggcuga

SEQ ID NO: 16851 - RNA, 21 nt, Artificial Sequence
  Synthetic
cuuuccacucagaguggcuga

SEQ ID NO: 16852 - RNA, 22 nt, Artificial Sequence
  Synthetic
gcuuuccacucagaguggcuga

SEQ ID NO: 16853 - RNA, 23 nt, Artificial Sequence
  Synthetic
ugcuuuccacucagaguggcuga

SEQ ID NO: 16854 - RNA, 24 nt, Artificial Sequence
  Synthetic
augcuuuccacucagaguggcuga

SEQ ID NO: 16855 - RNA, 18 nt, Artificial Sequence
  Synthetic
aggauccuaaccuuuuga

SEQ ID NO: 16856 - RNA, 19 nt, Artificial Sequence
  Synthetic
aaggauccuaaccuuuuga

SEQ ID NO: 16857 - RNA, 20 nt, Artificial Sequence
  Synthetic
aaaggauccuaaccuuuuga

SEQ ID NO: 16858 - RNA, 21 nt, Artificial Sequence
  Synthetic
aaaaggauccuaaccuuuuga

SEQ ID NO: 16859 - RNA, 22 nt, Artificial Sequence
  Synthetic
caaaaggauccuaaccuuuuga

SEQ ID NO: 16860 - RNA, 23 nt, Artificial Sequence
  Synthetic
ucaaaaggauccuaaccuuuuga

SEQ ID NO: 16861 - RNA, 24 nt, Artificial Sequence
  Synthetic
aucaaaaggauccuaaccuuuuga

SEQ ID NO: 16862 - RNA, 18 nt, Artificial Sequence
  Synthetic
agaguaagaagcuaaaua

SEQ ID NO: 16863 - RNA, 19 nt, Artificial Sequence
  Synthetic
cagaguaagaagcuaaaua

SEQ ID NO: 16864 - RNA, 21 nt, Artificial Sequence
  Synthetic
cucagaguaagaagcuaaaua

SEQ ID NO: 16865 - RNA, 22 nt, Artificial Sequence
  Synthetic
acucagaguaagaagcuaaaua

SEQ ID NO: 16866 - RNA, 23 nt, Artificial Sequence
  Synthetic
uacucagaguaagaagcuaaaua

SEQ ID NO: 16867 - RNA, 24 nt, Artificial Sequence
  Synthetic
uuacucagaguaagaagcuaaaua

SEQ ID NO: 16868 - RNA, 18 nt, Artificial Sequence
  Synthetic
aaacaaacaaaaaacaua

SEQ ID NO: 16869 - RNA, 19 nt, Artificial Sequence
  Synthetic
caaacaaacaaaaaacaua

SEQ ID NO: 16870 - RNA, 20 nt, Artificial Sequence
  Synthetic
acaaacaaacaaaaaacaua

SEQ ID NO: 16871 - RNA, 21 nt, Artificial Sequence
  Synthetic
cacaaacaaacaaaaaacaua

SEQ ID NO: 16872 - RNA, 22 nt, Artificial Sequence
  Synthetic
acacaaacaaacaaaaaacaua

SEQ ID NO: 16873 - RNA, 23 nt, Artificial Sequence
  Synthetic
aacacaaacaaacaaaaaacaua

SEQ ID NO: 16874 - RNA, 24 nt, Artificial Sequence
  Synthetic
caacacaaacaaacaaaaaacaua

SEQ ID NO: 16875 - RNA, 18 nt, Artificial Sequence
  Synthetic
guuuucuuuuaaauacua

SEQ ID NO: 16876 - RNA, 19 nt, Artificial Sequence
  Synthetic
uguuuucuuuuaaauacua

SEQ ID NO: 16877 - RNA, 20 nt, Artificial Sequence
  Synthetic
cuguuuucuuuuaaauacua

SEQ ID NO: 16878 - RNA, 21 nt, Artificial Sequence
  Synthetic
ucuguuuucuuuuaaauacua

SEQ ID NO: 16879 - RNA, 22 nt, Artificial Sequence
  Synthetic
uucuguuuucuuuuaaauacua

SEQ ID NO: 16880 - RNA, 23 nt, Artificial Sequence
  Synthetic
uuucuguuuucuuuuaaauacua

SEQ ID NO: 16881 - RNA, 24 nt, Artificial Sequence
  Synthetic
cuuucuguuuucuuuuaaauacua

SEQ ID NO: 16882 - RNA, 18 nt, Artificial Sequence
  Synthetic
gggggacuaccauuccua

SEQ ID NO: 16883 - RNA, 19 nt, Artificial Sequence
  Synthetic
ggggggacuaccauuccua

SEQ ID NO: 16884 - RNA, 20 nt, Artificial Sequence
  Synthetic
gggggggacuaccauuccua

SEQ ID NO: 16885 - RNA, 21 nt, Artificial Sequence
  Synthetic
ugggggggacuaccauuccua

SEQ ID NO: 16886 - RNA, 22 nt, Artificial Sequence
  Synthetic
augggggggacuaccauuccua

SEQ ID NO: 16887 - RNA, 23 nt, Artificial Sequence
  Synthetic
uaugggggggacuaccauuccua

SEQ ID NO: 16888 - RNA, 24 nt, Artificial Sequence
  Synthetic
uuaugggggggacuaccauuccua

SEQ ID NO: 16889 - RNA, 18 nt, Artificial Sequence
  Synthetic
uccccuagaagcuugcua

SEQ ID NO: 16890 - RNA, 19 nt, Artificial Sequence
  Synthetic
auccccuagaagcuugcua

SEQ ID NO: 16891 - RNA, 20 nt, Artificial Sequence
  Synthetic
cauccccuagaagcuugcua

SEQ ID NO: 16892 - RNA, 21 nt, Artificial Sequence
  Synthetic
gcauccccuagaagcuugcua

SEQ ID NO: 16893 - RNA, 22 nt, Artificial Sequence
  Synthetic
ggcauccccuagaagcuugcua

SEQ ID NO: 16894 - RNA, 23 nt, Artificial Sequence
  Synthetic
uggcauccccuagaagcuugcua

SEQ ID NO: 16895 - RNA, 24 nt, Artificial Sequence
  Synthetic
uuggcauccccuagaagcuugcua

SEQ ID NO: 16896 - RNA, 18 nt, Artificial Sequence
  Synthetic
uggcucuaaaucacucua

SEQ ID NO: 16897 - RNA, 19 nt, Artificial Sequence
  Synthetic
auggcucuaaaucacucua

SEQ ID NO: 16898 - RNA, 20 nt, Artificial Sequence
  Synthetic
cauggcucuaaaucacucua

SEQ ID NO: 16899 - RNA, 21 nt, Artificial Sequence
  Synthetic
acauggcucuaaaucacucua

SEQ ID NO: 16900 - RNA, 22 nt, Artificial Sequence
  Synthetic
aacauggcucuaaaucacucua

SEQ ID NO: 16901 - RNA, 23 nt, Artificial Sequence
  Synthetic
aaacauggcucuaaaucacucua

SEQ ID NO: 16902 - RNA, 24 nt, Artificial Sequence
  Synthetic
uaaacauggcucuaaaucacucua

SEQ ID NO: 16903 - RNA, 18 nt, Artificial Sequence
  Synthetic
guaaaugaaagugaagua

SEQ ID NO: 16904 - RNA, 19 nt, Artificial Sequence
  Synthetic
uguaaaugaaagugaagua

SEQ ID NO: 16905 - RNA, 20 nt, Artificial Sequence
  Synthetic
auguaaaugaaagugaagua

SEQ ID NO: 16906 - RNA, 21 nt, Artificial Sequence
  Synthetic
gauguaaaugaaagugaagua

SEQ ID NO: 16907 - RNA, 22 nt, Artificial Sequence
  Synthetic
agauguaaaugaaagugaagua

SEQ ID NO: 16908 - RNA, 23 nt, Artificial Sequence
  Synthetic
gagauguaaaugaaagugaagua

SEQ ID NO: 16909 - RNA, 24 nt, Artificial Sequence
  Synthetic
ugagauguaaaugaaagugaagua

SEQ ID NO: 16910 - RNA, 18 nt, Artificial Sequence
  Synthetic
cuuaauuuucaaacugua

SEQ ID NO: 16911 - RNA, 19 nt, Artificial Sequence
  Synthetic
ucuuaauuuucaaacugua

SEQ ID NO: 16912 - RNA, 20 nt, Artificial Sequence
  Synthetic
aucuuaauuuucaaacugua

SEQ ID NO: 16913 - RNA, 21 nt, Artificial Sequence
  Synthetic
caucuuaauuuucaaacugua

SEQ ID NO: 16914 - RNA, 22 nt, Artificial Sequence
  Synthetic
ucaucuuaauuuucaaacugua

SEQ ID NO: 16915 - RNA, 23 nt, Artificial Sequence
  Synthetic
aucaucuuaauuuucaaacugua

SEQ ID NO: 16916 - RNA, 24 nt, Artificial Sequence
  Synthetic
uaucaucuuaauuuucaaacugua

SEQ ID NO: 16917 - RNA, 18 nt, Artificial Sequence
  Synthetic
ugccacugauuucuguua

SEQ ID NO: 16918 - RNA, 19 nt, Artificial Sequence
  Synthetic
uugccacugauuucuguua

SEQ ID NO: 16919 - RNA, 20 nt, Artificial Sequence
  Synthetic
auugccacugauuucuguua

SEQ ID NO: 16920 - RNA, 21 nt, Artificial Sequence
  Synthetic
uauugccacugauuucuguua

SEQ ID NO: 16921 - RNA, 22 nt, Artificial Sequence
  Synthetic
uuauugccacugauuucuguua

SEQ ID NO: 16922 - RNA, 23 nt, Artificial Sequence
  Synthetic
guuauugccacugauuucuguua

SEQ ID NO: 16923 - RNA, 24 nt, Artificial Sequence
  Synthetic
aguuauugccacugauuucuguua

SEQ ID NO: 16924 - RNA, 18 nt, Artificial Sequence
  Synthetic
aaacugagagauucuuua

SEQ ID NO: 16925 - RNA, 19 nt, Artificial Sequence
  Synthetic
gaaacugagagauucuuua

SEQ ID NO: 16926 - RNA, 21 nt, Artificial Sequence
  Synthetic
aggaaacugagagauucuuua

SEQ ID NO: 16927 - RNA, 22 nt, Artificial Sequence
  Synthetic
aaggaaacugagagauucuuua

SEQ ID NO: 16928 - RNA, 23 nt, Artificial Sequence
  Synthetic
aaaggaaacugagagauucuuua

SEQ ID NO: 16929 - RNA, 24 nt, Artificial Sequence
  Synthetic
gaaaggaaacugagagauucuuua

SEQ ID NO: 16930 - RNA, 18 nt, Artificial Sequence
  Synthetic
gggggauacagugaaaac

SEQ ID NO: 16931 - RNA, 19 nt, Artificial Sequence
  Synthetic
ugggggauacagugaaaac

SEQ ID NO: 16932 - RNA, 21 nt, Artificial Sequence
  Synthetic
caugggggauacagugaaaac

SEQ ID NO: 16933 - RNA, 22 nt, Artificial Sequence
  Synthetic
acaugggggauacagugaaaac

SEQ ID NO: 16934 - RNA, 23 nt, Artificial Sequence
  Synthetic
aacaugggggauacagugaaaac

SEQ ID NO: 16935 - RNA, 24 nt, Artificial Sequence
  Synthetic
caacaugggggauacagugaaaac

SEQ ID NO: 16936 - RNA, 18 nt, Artificial Sequence
  Synthetic
uucuuuaaugggugaaac

SEQ ID NO: 16937 - RNA, 19 nt, Artificial Sequence
  Synthetic
uuucuuuaaugggugaaac

SEQ ID NO: 16938 - RNA, 20 nt, Artificial Sequence
  Synthetic
auuucuuuaaugggugaaac

SEQ ID NO: 16939 - RNA, 21 nt, Artificial Sequence
  Synthetic
aauuucuuuaaugggugaaac

SEQ ID NO: 16940 - RNA, 22 nt, Artificial Sequence
  Synthetic
gaauuucuuuaaugggugaaac

SEQ ID NO: 16941 - RNA, 23 nt, Artificial Sequence
  Synthetic
ggaauuucuuuaaugggugaaac

SEQ ID NO: 16942 - RNA, 24 nt, Artificial Sequence
  Synthetic
gggaauuucuuuaaugggugaaac

SEQ ID NO: 16943 - RNA, 18 nt, Artificial Sequence
  Synthetic
uuuuuaaauugaaucaac

SEQ ID NO: 16944 - RNA, 19 nt, Artificial Sequence
  Synthetic
uuuuuuaaauugaaucaac

SEQ ID NO: 16945 - RNA, 20 nt, Artificial Sequence
  Synthetic
auuuuuuaaauugaaucaac

SEQ ID NO: 16946 - RNA, 21 nt, Artificial Sequence
  Synthetic
uauuuuuuaaauugaaucaac

SEQ ID NO: 16947 - RNA, 22 nt, Artificial Sequence
  Synthetic
auauuuuuuaaauugaaucaac

SEQ ID NO: 16948 - RNA, 23 nt, Artificial Sequence
  Synthetic
uauauuuuuuaaauugaaucaac

SEQ ID NO: 16949 - RNA, 24 nt, Artificial Sequence
  Synthetic
guauauuuuuuaaauugaaucaac

SEQ ID NO: 16950 - RNA, 18 nt, Artificial Sequence
  Synthetic
ggagcaaagaguucuaac

SEQ ID NO: 16951 - RNA, 19 nt, Artificial Sequence
  Synthetic
aggagcaaagaguucuaac

SEQ ID NO: 16952 - RNA, 20 nt, Artificial Sequence
  Synthetic
uaggagcaaagaguucuaac

SEQ ID NO: 16953 - RNA, 21 nt, Artificial Sequence
  Synthetic
auaggagcaaagaguucuaac

SEQ ID NO: 16954 - RNA, 22 nt, Artificial Sequence
  Synthetic
gauaggagcaaagaguucuaac

SEQ ID NO: 16955 - RNA, 23 nt, Artificial Sequence
  Synthetic
agauaggagcaaagaguucuaac

SEQ ID NO: 16956 - RNA, 24 nt, Artificial Sequence
  Synthetic
aagauaggagcaaagaguucuaac

SEQ ID NO: 16957 - RNA, 18 nt, Artificial Sequence
  Synthetic
caaccaucuggcaaccac

SEQ ID NO: 16958 - RNA, 19 nt, Artificial Sequence
  Synthetic
ucaaccaucuggcaaccac

SEQ ID NO: 16959 - RNA, 20 nt, Artificial Sequence
  Synthetic
uucaaccaucuggcaaccac

SEQ ID NO: 16960 - RNA, 21 nt, Artificial Sequence
  Synthetic
cuucaaccaucuggcaaccac

SEQ ID NO: 16961 - RNA, 22 nt, Artificial Sequence
  Synthetic
ucuucaaccaucuggcaaccac

SEQ ID NO: 16962 - RNA, 23 nt, Artificial Sequence
  Synthetic
uucuucaaccaucuggcaaccac

SEQ ID NO: 16963 - RNA, 24 nt, Artificial Sequence
  Synthetic
guucuucaaccaucuggcaaccac

SEQ ID NO: 16964 - RNA, 18 nt, Artificial Sequence
  Synthetic
aaaaauuucaugaaccac

SEQ ID NO: 16965 - RNA, 19 nt, Artificial Sequence
  Synthetic
gaaaaauuucaugaaccac

SEQ ID NO: 16966 - RNA, 20 nt, Artificial Sequence
  Synthetic
ugaaaaauuucaugaaccac

SEQ ID NO: 16967 - RNA, 21 nt, Artificial Sequence
  Synthetic
augaaaaauuucaugaaccac

SEQ ID NO: 16968 - RNA, 22 nt, Artificial Sequence
  Synthetic
gaugaaaaauuucaugaaccac

SEQ ID NO: 16969 - RNA, 23 nt, Artificial Sequence
  Synthetic
agaugaaaaauuucaugaaccac

SEQ ID NO: 16970 - RNA, 24 nt, Artificial Sequence
  Synthetic
gagaugaaaaauuucaugaaccac

SEQ ID NO: 16971 - RNA, 18 nt, Artificial Sequence
  Synthetic
ugugaaaaagugguccac

SEQ ID NO: 16972 - RNA, 19 nt, Artificial Sequence
  Synthetic
augugaaaaagugguccac

SEQ ID NO: 16973 - RNA, 20 nt, Artificial Sequence
  Synthetic
aaugugaaaaagugguccac

SEQ ID NO: 16974 - RNA, 21 nt, Artificial Sequence
  Synthetic
caaugugaaaaagugguccac

SEQ ID NO: 16975 - RNA, 22 nt, Artificial Sequence
  Synthetic
ucaaugugaaaaagugguccac

SEQ ID NO: 16976 - RNA, 23 nt, Artificial Sequence
  Synthetic
uucaaugugaaaaagugguccac

SEQ ID NO: 16977 - RNA, 24 nt, Artificial Sequence
  Synthetic
guucaaugugaaaaagugguccac

SEQ ID NO: 16978 - RNA, 18 nt, Artificial Sequence
  Synthetic
aggcccuauucuaggcac

SEQ ID NO: 16979 - RNA, 19 nt, Artificial Sequence
  Synthetic
caggcccuauucuaggcac

SEQ ID NO: 16980 - RNA, 20 nt, Artificial Sequence
  Synthetic
ccaggcccuauucuaggcac

SEQ ID NO: 16981 - RNA, 21 nt, Artificial Sequence
  Synthetic
gccaggcccuauucuaggcac

SEQ ID NO: 16982 - RNA, 22 nt, Artificial Sequence
  Synthetic
ugccaggcccuauucuaggcac

SEQ ID NO: 16983 - RNA, 23 nt, Artificial Sequence
  Synthetic
augccaggcccuauucuaggcac

SEQ ID NO: 16984 - RNA, 24 nt, Artificial Sequence
  Synthetic
uaugccaggcccuauucuaggcac

SEQ ID NO: 16985 - RNA, 18 nt, Artificial Sequence
  Synthetic
cugaggcaggagaaucac

SEQ ID NO: 16986 - RNA, 19 nt, Artificial Sequence
  Synthetic
gcugaggcaggagaaucac

SEQ ID NO: 16987 - RNA, 20 nt, Artificial Sequence
  Synthetic
ggcugaggcaggagaaucac

SEQ ID NO: 16988 - RNA, 21 nt, Artificial Sequence
  Synthetic
aggcugaggcaggagaaucac

SEQ ID NO: 16989 - RNA, 22 nt, Artificial Sequence
  Synthetic
gaggcugaggcaggagaaucac

SEQ ID NO: 16990 - RNA, 23 nt, Artificial Sequence
  Synthetic
agaggcugaggcaggagaaucac

SEQ ID NO: 16991 - RNA, 24 nt, Artificial Sequence
  Synthetic
gagaggcugaggcaggagaaucac

SEQ ID NO: 16992 - RNA, 18 nt, Artificial Sequence
  Synthetic
ccaaggcgggcagaucac

SEQ ID NO: 16993 - RNA, 19 nt, Artificial Sequence
  Synthetic
gccaaggcgggcagaucac

SEQ ID NO: 16994 - RNA, 20 nt, Artificial Sequence
  Synthetic
ggccaaggcgggcagaucac

SEQ ID NO: 16995 - RNA, 21 nt, Artificial Sequence
  Synthetic
aggccaaggcgggcagaucac

SEQ ID NO: 16996 - RNA, 22 nt, Artificial Sequence
  Synthetic
gaggccaaggcgggcagaucac

SEQ ID NO: 16997 - RNA, 23 nt, Artificial Sequence
  Synthetic
ggaggccaaggcgggcagaucac

SEQ ID NO: 16998 - RNA, 24 nt, Artificial Sequence
  Synthetic
gggaggccaaggcgggcagaucac

SEQ ID NO: 16999 - RNA, 18 nt, Artificial Sequence
  Synthetic
ccaaggugggcagaucac

SEQ ID NO: 17000 - RNA, 19 nt, Artificial Sequence
  Synthetic
gccaaggugggcagaucac

SEQ ID NO: 17001 - RNA, 20 nt, Artificial Sequence
  Synthetic
ggccaaggugggcagaucac

SEQ ID NO: 17002 - RNA, 21 nt, Artificial Sequence
  Synthetic
aggccaaggugggcagaucac

SEQ ID NO: 17003 - RNA, 22 nt, Artificial Sequence
  Synthetic
gaggccaaggugggcagaucac

SEQ ID NO: 17004 - RNA, 23 nt, Artificial Sequence
  Synthetic
ggaggccaaggugggcagaucac

SEQ ID NO: 17005 - RNA, 24 nt, Artificial Sequence
  Synthetic
gggaggccaaggugggcagaucac

SEQ ID NO: 17006 - RNA, 18 nt, Artificial Sequence
  Synthetic
aaagugaaguagagagac

SEQ ID NO: 17007 - RNA, 19 nt, Artificial Sequence
  Synthetic
gaaagugaaguagagagac

SEQ ID NO: 17008 - RNA, 20 nt, Artificial Sequence
  Synthetic
ugaaagugaaguagagagac

SEQ ID NO: 17009 - RNA, 21 nt, Artificial Sequence
  Synthetic
augaaagugaaguagagagac

SEQ ID NO: 17010 - RNA, 22 nt, Artificial Sequence
  Synthetic
aaugaaagugaaguagagagac

SEQ ID NO: 17011 - RNA, 23 nt, Artificial Sequence
  Synthetic
aaaugaaagugaaguagagagac

SEQ ID NO: 17012 - RNA, 24 nt, Artificial Sequence
  Synthetic
uaaaugaaagugaaguagagagac

SEQ ID NO: 17013 - RNA, 18 nt, Artificial Sequence
  Synthetic
gccuguaaacccagcuac

SEQ ID NO: 17014 - RNA, 19 nt, Artificial Sequence
  Synthetic
ugccuguaaacccagcuac

SEQ ID NO: 17015 - RNA, 20 nt, Artificial Sequence
  Synthetic
gugccuguaaacccagcuac

SEQ ID NO: 17016 - RNA, 21 nt, Artificial Sequence
  Synthetic
agugccuguaaacccagcuac

SEQ ID NO: 17017 - RNA, 22 nt, Artificial Sequence
  Synthetic
gagugccuguaaacccagcuac

SEQ ID NO: 17018 - RNA, 23 nt, Artificial Sequence
  Synthetic
cgagugccuguaaacccagcuac

SEQ ID NO: 17019 - RNA, 24 nt, Artificial Sequence
  Synthetic
gcgagugccuguaaacccagcuac

SEQ ID NO: 17020 - RNA, 18 nt, Artificial Sequence
  Synthetic
auagaaugggguaguuac

SEQ ID NO: 17021 - RNA, 19 nt, Artificial Sequence
  Synthetic
aauagaaugggguaguuac

SEQ ID NO: 17022 - RNA, 20 nt, Artificial Sequence
  Synthetic
aaauagaaugggguaguuac

SEQ ID NO: 17023 - RNA, 21 nt, Artificial Sequence
  Synthetic
aaaauagaaugggguaguuac

SEQ ID NO: 17024 - RNA, 22 nt, Artificial Sequence
  Synthetic
aaaaauagaaugggguaguuac

SEQ ID NO: 17025 - RNA, 23 nt, Artificial Sequence
  Synthetic
aaaaaauagaaugggguaguuac

SEQ ID NO: 17026 - RNA, 24 nt, Artificial Sequence
  Synthetic
gaaaaaauagaaugggguaguuac

SEQ ID NO: 17027 - RNA, 18 nt, Artificial Sequence
  Synthetic
aggagaaucacuugaacc

SEQ ID NO: 17028 - RNA, 19 nt, Artificial Sequence
  Synthetic
caggagaaucacuugaacc

SEQ ID NO: 17029 - RNA, 20 nt, Artificial Sequence
  Synthetic
gcaggagaaucacuugaacc

SEQ ID NO: 17030 - RNA, 21 nt, Artificial Sequence
  Synthetic
ggcaggagaaucacuugaacc

SEQ ID NO: 17031 - RNA, 22 nt, Artificial Sequence
  Synthetic
aggcaggagaaucacuugaacc

SEQ ID NO: 17032 - RNA, 23 nt, Artificial Sequence
  Synthetic
gaggcaggagaaucacuugaacc

SEQ ID NO: 17033 - RNA, 24 nt, Artificial Sequence
  Synthetic
ugaggcaggagaaucacuugaacc

SEQ ID NO: 17034 - RNA, 18 nt, Artificial Sequence
  Synthetic
cugagauucgcuugaacc

SEQ ID NO: 17035 - RNA, 19 nt, Artificial Sequence
  Synthetic
acugagauucgcuugaacc

SEQ ID NO: 17036 - RNA, 20 nt, Artificial Sequence
  Synthetic
gacugagauucgcuugaacc

SEQ ID NO: 17037 - RNA, 21 nt, Artificial Sequence
  Synthetic
agacugagauucgcuugaacc

SEQ ID NO: 17038 - RNA, 22 nt, Artificial Sequence
  Synthetic
gagacugagauucgcuugaacc

SEQ ID NO: 17039 - RNA, 23 nt, Artificial Sequence
  Synthetic
ggagacugagauucgcuugaacc

SEQ ID NO: 17040 - RNA, 24 nt, Artificial Sequence
  Synthetic
aggagacugagauucgcuugaacc

SEQ ID NO: 17041 - RNA, 18 nt, Artificial Sequence
  Synthetic
gagcaaagaguucuaacc

SEQ ID NO: 17042 - RNA, 19 nt, Artificial Sequence
  Synthetic
ggagcaaagaguucuaacc

SEQ ID NO: 17043 - RNA, 21 nt, Artificial Sequence
  Synthetic
uaggagcaaagaguucuaacc

SEQ ID NO: 17044 - RNA, 22 nt, Artificial Sequence
  Synthetic
auaggagcaaagaguucuaacc

SEQ ID NO: 17045 - RNA, 23 nt, Artificial Sequence
  Synthetic
gauaggagcaaagaguucuaacc

SEQ ID NO: 17046 - RNA, 24 nt, Artificial Sequence
  Synthetic
agauaggagcaaagaguucuaacc

SEQ ID NO: 17047 - RNA, 18 nt, Artificial Sequence
  Synthetic
aagugaaguagagagacc

SEQ ID NO: 17048 - RNA, 19 nt, Artificial Sequence
  Synthetic
aaagugaaguagagagacc

SEQ ID NO: 17049 - RNA, 21 nt, Artificial Sequence
  Synthetic
ugaaagugaaguagagagacc

SEQ ID NO: 17050 - RNA, 22 nt, Artificial Sequence
  Synthetic
augaaagugaaguagagagacc

SEQ ID NO: 17051 - RNA, 23 nt, Artificial Sequence
  Synthetic
aaugaaagugaaguagagagacc

SEQ ID NO: 17052 - RNA, 24 nt, Artificial Sequence
  Synthetic
aaaugaaagugaaguagagagacc

SEQ ID NO: 17053 - RNA, 18 nt, Artificial Sequence
  Synthetic
aagaggucucuagugacc

SEQ ID NO: 17054 - RNA, 19 nt, Artificial Sequence
  Synthetic
uaagaggucucuagugacc

SEQ ID NO: 17055 - RNA, 20 nt, Artificial Sequence
  Synthetic
auaagaggucucuagugacc

SEQ ID NO: 17056 - RNA, 21 nt, Artificial Sequence
  Synthetic
cauaagaggucucuagugacc

SEQ ID NO: 17057 - RNA, 22 nt, Artificial Sequence
  Synthetic
ucauaagaggucucuagugacc

SEQ ID NO: 17058 - RNA, 23 nt, Artificial Sequence
  Synthetic
uucauaagaggucucuagugacc

SEQ ID NO: 17059 - RNA, 24 nt, Artificial Sequence
  Synthetic
uuucauaagaggucucuagugacc

SEQ ID NO: 17060 - RNA, 18 nt, Artificial Sequence
  Synthetic
ggagaaucacuugaaccc

SEQ ID NO: 17061 - RNA, 19 nt, Artificial Sequence
  Synthetic
aggagaaucacuugaaccc

SEQ ID NO: 17062 - RNA, 21 nt, Artificial Sequence
  Synthetic
gcaggagaaucacuugaaccc

SEQ ID NO: 17063 - RNA, 22 nt, Artificial Sequence
  Synthetic
ggcaggagaaucacuugaaccc

SEQ ID NO: 17064 - RNA, 23 nt, Artificial Sequence
  Synthetic
aggcaggagaaucacuugaaccc

SEQ ID NO: 17065 - RNA, 24 nt, Artificial Sequence
  Synthetic
gaggcaggagaaucacuugaaccc

SEQ ID NO: 17066 - RNA, 18 nt, Artificial Sequence
  Synthetic
ugagauucgcuugaaccc

SEQ ID NO: 17067 - RNA, 19 nt, Artificial Sequence
  Synthetic
cugagauucgcuugaaccc

SEQ ID NO: 17068 - RNA, 21 nt, Artificial Sequence
  Synthetic
gacugagauucgcuugaaccc

SEQ ID NO: 17069 - RNA, 22 nt, Artificial Sequence
  Synthetic
agacugagauucgcuugaaccc

SEQ ID NO: 17070 - RNA, 23 nt, Artificial Sequence
  Synthetic
gagacugagauucgcuugaaccc

SEQ ID NO: 17071 - RNA, 24 nt, Artificial Sequence
  Synthetic
ggagacugagauucgcuugaaccc

SEQ ID NO: 17072 - RNA, 18 nt, Artificial Sequence
  Synthetic
auggaucuuggcaucccc

SEQ ID NO: 17073 - RNA, 19 nt, Artificial Sequence
  Synthetic
cauggaucuuggcaucccc

SEQ ID NO: 17074 - RNA, 20 nt, Artificial Sequence
  Synthetic
gcauggaucuuggcaucccc

SEQ ID NO: 17075 - RNA, 21 nt, Artificial Sequence
  Synthetic
agcauggaucuuggcaucccc

SEQ ID NO: 17076 - RNA, 22 nt, Artificial Sequence
  Synthetic
aagcauggaucuuggcaucccc

SEQ ID NO: 17077 - RNA, 23 nt, Artificial Sequence
  Synthetic
uaagcauggaucuuggcaucccc

SEQ ID NO: 17078 - RNA, 24 nt, Artificial Sequence
  Synthetic
cuaagcauggaucuuggcaucccc

SEQ ID NO: 17079 - RNA, 18 nt, Artificial Sequence
  Synthetic
cuagacuaugaguggccc

SEQ ID NO: 17080 - RNA, 19 nt, Artificial Sequence
  Synthetic
ucuagacuaugaguggccc

SEQ ID NO: 17081 - RNA, 20 nt, Artificial Sequence
  Synthetic
uucuagacuaugaguggccc

SEQ ID NO: 17082 - RNA, 21 nt, Artificial Sequence
  Synthetic
auucuagacuaugaguggccc

SEQ ID NO: 17083 - RNA, 22 nt, Artificial Sequence
  Synthetic
cauucuagacuaugaguggccc

SEQ ID NO: 17084 - RNA, 23 nt, Artificial Sequence
  Synthetic
ucauucuagacuaugaguggccc

SEQ ID NO: 17085 - RNA, 24 nt, Artificial Sequence
  Synthetic
uucauucuagacuaugaguggccc

SEQ ID NO: 17086 - RNA, 18 nt, Artificial Sequence
  Synthetic
auuaccuuaagacuuccc

SEQ ID NO: 17087 - RNA, 19 nt, Artificial Sequence
  Synthetic
cauuaccuuaagacuuccc

SEQ ID NO: 17088 - RNA, 21 nt, Artificial Sequence
  Synthetic
gccauuaccuuaagacuuccc

SEQ ID NO: 17089 - RNA, 22 nt, Artificial Sequence
  Synthetic
agccauuaccuuaagacuuccc

SEQ ID NO: 17090 - RNA, 23 nt, Artificial Sequence
  Synthetic
uagccauuaccuuaagacuuccc

SEQ ID NO: 17091 - RNA, 24 nt, Artificial Sequence
  Synthetic
guagccauuaccuuaagacuuccc

SEQ ID NO: 17092 - RNA, 18 nt, Artificial Sequence
  Synthetic
ggaucagaugggaaagcc

SEQ ID NO: 17093 - RNA, 19 nt, Artificial Sequence
  Synthetic
uggaucagaugggaaagcc

SEQ ID NO: 17094 - RNA, 20 nt, Artificial Sequence
  Synthetic
auggaucagaugggaaagcc

SEQ ID NO: 17095 - RNA, 21 nt, Artificial Sequence
  Synthetic
aauggaucagaugggaaagcc

SEQ ID NO: 17096 - RNA, 22 nt, Artificial Sequence
  Synthetic
aaauggaucagaugggaaagcc

SEQ ID NO: 17097 - RNA, 23 nt, Artificial Sequence
  Synthetic
gaaauggaucagaugggaaagcc

SEQ ID NO: 17098 - RNA, 24 nt, Artificial Sequence
  Synthetic
agaaauggaucagaugggaaagcc

SEQ ID NO: 17099 - RNA, 18 nt, Artificial Sequence
  Synthetic
gauuuuucacauuuagcc

SEQ ID NO: 17100 - RNA, 19 nt, Artificial Sequence
  Synthetic
ggauuuuucacauuuagcc

SEQ ID NO: 17101 - RNA, 20 nt, Artificial Sequence
  Synthetic
gggauuuuucacauuuagcc

SEQ ID NO: 17102 - RNA, 21 nt, Artificial Sequence
  Synthetic
ugggauuuuucacauuuagcc

SEQ ID NO: 17103 - RNA, 22 nt, Artificial Sequence
  Synthetic
cugggauuuuucacauuuagcc

SEQ ID NO: 17104 - RNA, 23 nt, Artificial Sequence
  Synthetic
ucugggauuuuucacauuuagcc

SEQ ID NO: 17105 - RNA, 24 nt, Artificial Sequence
  Synthetic
cucugggauuuuucacauuuagcc

SEQ ID NO: 17106 - RNA, 18 nt, Artificial Sequence
  Synthetic
gggggggacuaccauucc

SEQ ID NO: 17107 - RNA, 19 nt, Artificial Sequence
  Synthetic
ugggggggacuaccauucc

SEQ ID NO: 17108 - RNA, 20 nt, Artificial Sequence
  Synthetic
augggggggacuaccauucc

SEQ ID NO: 17109 - RNA, 21 nt, Artificial Sequence
  Synthetic
uaugggggggacuaccauucc

SEQ ID NO: 17110 - RNA, 22 nt, Artificial Sequence
  Synthetic
uuaugggggggacuaccauucc

SEQ ID NO: 17111 - RNA, 23 nt, Artificial Sequence
  Synthetic
uuuaugggggggacuaccauucc

SEQ ID NO: 17112 - RNA, 24 nt, Artificial Sequence
  Synthetic
cuuuaugggggggacuaccauucc

SEQ ID NO: 17113 - RNA, 18 nt, Artificial Sequence
  Synthetic
cauuaccuuaagacuucc

SEQ ID NO: 17114 - RNA, 19 nt, Artificial Sequence
  Synthetic
ccauuaccuuaagacuucc

SEQ ID NO: 17115 - RNA, 20 nt, Artificial Sequence
  Synthetic
gccauuaccuuaagacuucc

SEQ ID NO: 17116 - RNA, 21 nt, Artificial Sequence
  Synthetic
agccauuaccuuaagacuucc

SEQ ID NO: 17117 - RNA, 22 nt, Artificial Sequence
  Synthetic
uagccauuaccuuaagacuucc

SEQ ID NO: 17118 - RNA, 23 nt, Artificial Sequence
  Synthetic
guagccauuaccuuaagacuucc

SEQ ID NO: 17119 - RNA, 24 nt, Artificial Sequence
  Synthetic
aguagccauuaccuuaagacuucc

SEQ ID NO: 17120 - RNA, 18 nt, Artificial Sequence
  Synthetic
gcaccauuacacuccagc

SEQ ID NO: 17121 - RNA, 19 nt, Artificial Sequence
  Synthetic
ugcaccauuacacuccagc

SEQ ID NO: 17122 - RNA, 20 nt, Artificial Sequence
  Synthetic
uugcaccauuacacuccagc

SEQ ID NO: 17123 - RNA, 21 nt, Artificial Sequence
  Synthetic
auugcaccauuacacuccagc

SEQ ID NO: 17124 - RNA, 22 nt, Artificial Sequence
  Synthetic
aauugcaccauuacacuccagc

SEQ ID NO: 17125 - RNA, 23 nt, Artificial Sequence
  Synthetic
aaauugcaccauuacacuccagc

SEQ ID NO: 17126 - RNA, 24 nt, Artificial Sequence
  Synthetic
aaaauugcaccauuacacuccagc

SEQ ID NO: 17127 - RNA, 18 nt, Artificial Sequence
  Synthetic
caggagacugagauucgc

SEQ ID NO: 17128 - RNA, 19 nt, Artificial Sequence
  Synthetic
ucaggagacugagauucgc

SEQ ID NO: 17129 - RNA, 20 nt, Artificial Sequence
  Synthetic
cucaggagacugagauucgc

SEQ ID NO: 17130 - RNA, 21 nt, Artificial Sequence
  Synthetic
acucaggagacugagauucgc

SEQ ID NO: 17131 - RNA, 22 nt, Artificial Sequence
  Synthetic
uacucaggagacugagauucgc

SEQ ID NO: 17132 - RNA, 23 nt, Artificial Sequence
  Synthetic
cuacucaggagacugagauucgc

SEQ ID NO: 17133 - RNA, 24 nt, Artificial Sequence
  Synthetic
gcuacucaggagacugagauucgc

SEQ ID NO: 17134 - RNA, 18 nt, Artificial Sequence
  Synthetic
uacucgagaggcugaggc

SEQ ID NO: 17135 - RNA, 19 nt, Artificial Sequence
  Synthetic
cuacucgagaggcugaggc

SEQ ID NO: 17136 - RNA, 21 nt, Artificial Sequence
  Synthetic
agcuacucgagaggcugaggc

SEQ ID NO: 17137 - RNA, 22 nt, Artificial Sequence
  Synthetic
cagcuacucgagaggcugaggc

SEQ ID NO: 17138 - RNA, 23 nt, Artificial Sequence
  Synthetic
ccagcuacucgagaggcugaggc

SEQ ID NO: 17139 - RNA, 24 nt, Artificial Sequence
  Synthetic
cccagcuacucgagaggcugaggc

SEQ ID NO: 17140 - RNA, 18 nt, Artificial Sequence
  Synthetic
ucuaaaggaguaauaggc

SEQ ID NO: 17141 - RNA, 19 nt, Artificial Sequence
  Synthetic
cucuaaaggaguaauaggc

SEQ ID NO: 17142 - RNA, 21 nt, Artificial Sequence
  Synthetic
cacucuaaaggaguaauaggc

SEQ ID NO: 17143 - RNA, 22 nt, Artificial Sequence
  Synthetic
ucacucuaaaggaguaauaggc

SEQ ID NO: 17144 - RNA, 23 nt, Artificial Sequence
  Synthetic
aucacucuaaaggaguaauaggc

SEQ ID NO: 17145 - RNA, 24 nt, Artificial Sequence
  Synthetic
aaucacucuaaaggaguaauaggc

SEQ ID NO: 17146 - RNA, 18 nt, Artificial Sequence
  Synthetic
caggccugugcuguuggc

SEQ ID NO: 17147 - RNA, 19 nt, Artificial Sequence
  Synthetic
ucaggccugugcuguuggc

SEQ ID NO: 17148 - RNA, 20 nt, Artificial Sequence
  Synthetic
aucaggccugugcuguuggc

SEQ ID NO: 17149 - RNA, 21 nt, Artificial Sequence
  Synthetic
caucaggccugugcuguuggc

SEQ ID NO: 17150 - RNA, 22 nt, Artificial Sequence
  Synthetic
gcaucaggccugugcuguuggc

SEQ ID NO: 17151 - RNA, 23 nt, Artificial Sequence
  Synthetic
ggcaucaggccugugcuguuggc

SEQ ID NO: 17152 - RNA, 24 nt, Artificial Sequence
  Synthetic
uggcaucaggccugugcuguuggc

SEQ ID NO: 17153 - RNA, 18 nt, Artificial Sequence
  Synthetic
cauauccugacuacaauc

SEQ ID NO: 17154 - RNA, 19 nt, Artificial Sequence
  Synthetic
ucauauccugacuacaauc

SEQ ID NO: 17155 - RNA, 20 nt, Artificial Sequence
  Synthetic
uucauauccugacuacaauc

SEQ ID NO: 17156 - RNA, 21 nt, Artificial Sequence
  Synthetic
guucauauccugacuacaauc

SEQ ID NO: 17157 - RNA, 22 nt, Artificial Sequence
  Synthetic
aguucauauccugacuacaauc

SEQ ID NO: 17158 - RNA, 23 nt, Artificial Sequence
  Synthetic
aaguucauauccugacuacaauc

SEQ ID NO: 17159 - RNA, 24 nt, Artificial Sequence
  Synthetic
aaaguucauauccugacuacaauc

SEQ ID NO: 17160 - RNA, 18 nt, Artificial Sequence
  Synthetic
cuguaaacccagcuacuc

SEQ ID NO: 17161 - RNA, 19 nt, Artificial Sequence
  Synthetic
ccuguaaacccagcuacuc

SEQ ID NO: 17162 - RNA, 20 nt, Artificial Sequence
  Synthetic
gccuguaaacccagcuacuc

SEQ ID NO: 17163 - RNA, 21 nt, Artificial Sequence
  Synthetic
ugccuguaaacccagcuacuc

SEQ ID NO: 17164 - RNA, 22 nt, Artificial Sequence
  Synthetic
gugccuguaaacccagcuacuc

SEQ ID NO: 17165 - RNA, 23 nt, Artificial Sequence
  Synthetic
agugccuguaaacccagcuacuc

SEQ ID NO: 17166 - RNA, 24 nt, Artificial Sequence
  Synthetic
gagugccuguaaacccagcuacuc

SEQ ID NO: 17167 - RNA, 18 nt, Artificial Sequence
  Synthetic
cuguagucccagcuacuc

SEQ ID NO: 17168 - RNA, 19 nt, Artificial Sequence
  Synthetic
ccuguagucccagcuacuc

SEQ ID NO: 17169 - RNA, 21 nt, Artificial Sequence
  Synthetic
ugccuguagucccagcuacuc

SEQ ID NO: 17170 - RNA, 22 nt, Artificial Sequence
  Synthetic
augccuguagucccagcuacuc

SEQ ID NO: 17171 - RNA, 23 nt, Artificial Sequence
  Synthetic
caugccuguagucccagcuacuc

SEQ ID NO: 17172 - RNA, 24 nt, Artificial Sequence
  Synthetic
gcaugccuguagucccagcuacuc

SEQ ID NO: 17173 - RNA, 18 nt, Artificial Sequence
  Synthetic
ugaggagaaggcaagguc

SEQ ID NO: 17174 - RNA, 19 nt, Artificial Sequence
  Synthetic
cugaggagaaggcaagguc

SEQ ID NO: 17175 - RNA, 21 nt, Artificial Sequence
  Synthetic
accugaggagaaggcaagguc

SEQ ID NO: 17176 - RNA, 22 nt, Artificial Sequence
  Synthetic
uaccugaggagaaggcaagguc

SEQ ID NO: 17177 - RNA, 23 nt, Artificial Sequence
  Synthetic
uuaccugaggagaaggcaagguc

SEQ ID NO: 17178 - RNA, 24 nt, Artificial Sequence
  Synthetic
guuaccugaggagaaggcaagguc

SEQ ID NO: 17179 - RNA, 18 nt, Artificial Sequence
  Synthetic
ugguggaaaccauacuuc

SEQ ID NO: 17180 - RNA, 19 nt, Artificial Sequence
  Synthetic
augguggaaaccauacuuc

SEQ ID NO: 17181 - RNA, 21 nt, Artificial Sequence
  Synthetic
acaugguggaaaccauacuuc

SEQ ID NO: 17182 - RNA, 22 nt, Artificial Sequence
  Synthetic
aacaugguggaaaccauacuuc

SEQ ID NO: 17183 - RNA, 23 nt, Artificial Sequence
  Synthetic
gaacaugguggaaaccauacuuc

SEQ ID NO: 17184 - RNA, 24 nt, Artificial Sequence
  Synthetic
ggaacaugguggaaaccauacuuc

SEQ ID NO: 17185 - RNA, 18 nt, Artificial Sequence
  Synthetic
ucacauaguucaggcuuc

SEQ ID NO: 17186 - RNA, 19 nt, Artificial Sequence
  Synthetic
uucacauaguucaggcuuc

SEQ ID NO: 17187 - RNA, 20 nt, Artificial Sequence
  Synthetic
cuucacauaguucaggcuuc

SEQ ID NO: 17188 - RNA, 21 nt, Artificial Sequence
  Synthetic
ucuucacauaguucaggcuuc

SEQ ID NO: 17189 - RNA, 22 nt, Artificial Sequence
  Synthetic
gucuucacauaguucaggcuuc

SEQ ID NO: 17190 - RNA, 23 nt, Artificial Sequence
  Synthetic
ggucuucacauaguucaggcuuc

SEQ ID NO: 17191 - RNA, 24 nt, Artificial Sequence
  Synthetic
aggucuucacauaguucaggcuuc

SEQ ID NO: 17192 - RNA, 18 nt, Artificial Sequence
  Synthetic
acagagaugaaaaauuuc

SEQ ID NO: 17193 - RNA, 19 nt, Artificial Sequence
  Synthetic
uacagagaugaaaaauuuc

SEQ ID NO: 17194 - RNA, 20 nt, Artificial Sequence
  Synthetic
guacagagaugaaaaauuuc

SEQ ID NO: 17195 - RNA, 21 nt, Artificial Sequence
  Synthetic
uguacagagaugaaaaauuuc

SEQ ID NO: 17196 - RNA, 22 nt, Artificial Sequence
  Synthetic
cuguacagagaugaaaaauuuc

SEQ ID NO: 17197 - RNA, 23 nt, Artificial Sequence
  Synthetic
acuguacagagaugaaaaauuuc

SEQ ID NO: 17198 - RNA, 24 nt, Artificial Sequence
  Synthetic
aacuguacagagaugaaaaauuuc

SEQ ID NO: 17199 - RNA, 18 nt, Artificial Sequence
  Synthetic
accaaauguguauuuuuc

SEQ ID NO: 17200 - RNA, 19 nt, Artificial Sequence
  Synthetic
aaccaaauguguauuuuuc

SEQ ID NO: 17201 - RNA, 21 nt, Artificial Sequence
  Synthetic
gaaaccaaauguguauuuuuc

SEQ ID NO: 17202 - RNA, 22 nt, Artificial Sequence
  Synthetic
ugaaaccaaauguguauuuuuc

SEQ ID NO: 17203 - RNA, 23 nt, Artificial Sequence
  Synthetic
cugaaaccaaauguguauuuuuc

SEQ ID NO: 17204 - RNA, 24 nt, Artificial Sequence
  Synthetic
ucugaaaccaaauguguauuuuuc

SEQ ID NO: 17205 - RNA, 18 nt, Artificial Sequence
  Synthetic
ucaccuucuccaucaaag

SEQ ID NO: 17206 - RNA, 19 nt, Artificial Sequence
  Synthetic
cucaccuucuccaucaaag

SEQ ID NO: 17207 - RNA, 20 nt, Artificial Sequence
  Synthetic
acucaccuucuccaucaaag

SEQ ID NO: 17208 - RNA, 21 nt, Artificial Sequence
  Synthetic
gacucaccuucuccaucaaag

SEQ ID NO: 17209 - RNA, 22 nt, Artificial Sequence
  Synthetic
agacucaccuucuccaucaaag

SEQ ID NO: 17210 - RNA, 23 nt, Artificial Sequence
  Synthetic
cagacucaccuucuccaucaaag

SEQ ID NO: 17211 - RNA, 24 nt, Artificial Sequence
  Synthetic
gcagacucaccuucuccaucaaag

SEQ ID NO: 17212 - RNA, 18 nt, Artificial Sequence
  Synthetic
aaacuuagauauucaaag

SEQ ID NO: 17213 - RNA, 19 nt, Artificial Sequence
  Synthetic
aaaacuuagauauucaaag

SEQ ID NO: 17214 - RNA, 20 nt, Artificial Sequence
  Synthetic
uaaaacuuagauauucaaag

SEQ ID NO: 17215 - RNA, 21 nt, Artificial Sequence
  Synthetic
uuaaaacuuagauauucaaag

SEQ ID NO: 17216 - RNA, 22 nt, Artificial Sequence
  Synthetic
auuaaaacuuagauauucaaag

SEQ ID NO: 17217 - RNA, 23 nt, Artificial Sequence
  Synthetic
aauuaaaacuuagauauucaaag

SEQ ID NO: 17218 - RNA, 24 nt, Artificial Sequence
  Synthetic
caauuaaaacuuagauauucaaag

SEQ ID NO: 17219 - RNA, 18 nt, Artificial Sequence
  Synthetic
acacuuugggaggccaag

SEQ ID NO: 17220 - RNA, 19 nt, Artificial Sequence
  Synthetic
aacacuuugggaggccaag

SEQ ID NO: 17221 - RNA, 20 nt, Artificial Sequence
  Synthetic
caacacuuugggaggccaag

SEQ ID NO: 17222 - RNA, 21 nt, Artificial Sequence
  Synthetic
ccaacacuuugggaggccaag

SEQ ID NO: 17223 - RNA, 22 nt, Artificial Sequence
  Synthetic
cccaacacuuugggaggccaag

SEQ ID NO: 17224 - RNA, 23 nt, Artificial Sequence
  Synthetic
ucccaacacuuugggaggccaag

SEQ ID NO: 17225 - RNA, 24 nt, Artificial Sequence
  Synthetic
aucccaacacuuugggaggccaag

SEQ ID NO: 17226 - RNA, 18 nt, Artificial Sequence
  Synthetic
gcauuuugggaggccaag

SEQ ID NO: 17227 - RNA, 19 nt, Artificial Sequence
  Synthetic
agcauuuugggaggccaag

SEQ ID NO: 17228 - RNA, 20 nt, Artificial Sequence
  Synthetic
cagcauuuugggaggccaag

SEQ ID NO: 17229 - RNA, 21 nt, Artificial Sequence
  Synthetic
ccagcauuuugggaggccaag

SEQ ID NO: 17230 - RNA, 22 nt, Artificial Sequence
  Synthetic
cccagcauuuugggaggccaag

SEQ ID NO: 17231 - RNA, 23 nt, Artificial Sequence
  Synthetic
ucccagcauuuugggaggccaag

SEQ ID NO: 17232 - RNA, 24 nt, Artificial Sequence
  Synthetic
aucccagcauuuugggaggccaag

SEQ ID NO: 17233 - RNA, 18 nt, Artificial Sequence
  Synthetic
auguaaaugaaagugaag

SEQ ID NO: 17234 - RNA, 19 nt, Artificial Sequence
  Synthetic
gauguaaaugaaagugaag

SEQ ID NO: 17235 - RNA, 20 nt, Artificial Sequence
  Synthetic
agauguaaaugaaagugaag

SEQ ID NO: 17236 - RNA, 21 nt, Artificial Sequence
  Synthetic
gagauguaaaugaaagugaag

SEQ ID NO: 17237 - RNA, 22 nt, Artificial Sequence
  Synthetic
ugagauguaaaugaaagugaag

SEQ ID NO: 17238 - RNA, 23 nt, Artificial Sequence
  Synthetic
cugagauguaaaugaaagugaag

SEQ ID NO: 17239 - RNA, 24 nt, Artificial Sequence
  Synthetic
gcugagauguaaaugaaagugaag

SEQ ID NO: 17240 - RNA, 18 nt, Artificial Sequence
  Synthetic
uaaaggaguaauacacag

SEQ ID NO: 17241 - RNA, 19 nt, Artificial Sequence
  Synthetic
auaaaggaguaauacacag

SEQ ID NO: 17242 - RNA, 20 nt, Artificial Sequence
  Synthetic
cauaaaggaguaauacacag

SEQ ID NO: 17243 - RNA, 21 nt, Artificial Sequence
  Synthetic
acauaaaggaguaauacacag

SEQ ID NO: 17244 - RNA, 22 nt, Artificial Sequence
  Synthetic
aacauaaaggaguaauacacag

SEQ ID NO: 17245 - RNA, 23 nt, Artificial Sequence
  Synthetic
aaacauaaaggaguaauacacag

SEQ ID NO: 17246 - RNA, 24 nt, Artificial Sequence
  Synthetic
aaaacauaaaggaguaauacacag

SEQ ID NO: 17247 - RNA, 18 nt, Artificial Sequence
  Synthetic
gugaaguagagagaccag

SEQ ID NO: 17248 - RNA, 19 nt, Artificial Sequence
  Synthetic
agugaaguagagagaccag

SEQ ID NO: 17249 - RNA, 20 nt, Artificial Sequence
  Synthetic
aagugaaguagagagaccag

SEQ ID NO: 17250 - RNA, 21 nt, Artificial Sequence
  Synthetic
aaagugaaguagagagaccag

SEQ ID NO: 17251 - RNA, 22 nt, Artificial Sequence
  Synthetic
gaaagugaaguagagagaccag

SEQ ID NO: 17252 - RNA, 23 nt, Artificial Sequence
  Synthetic
ugaaagugaaguagagagaccag

SEQ ID NO: 17253 - RNA, 24 nt, Artificial Sequence
  Synthetic
augaaagugaaguagagagaccag

SEQ ID NO: 17254 - RNA, 18 nt, Artificial Sequence
  Synthetic
auaccaggcccagaucag

SEQ ID NO: 17255 - RNA, 19 nt, Artificial Sequence
  Synthetic
cauaccaggcccagaucag

SEQ ID NO: 17256 - RNA, 20 nt, Artificial Sequence
  Synthetic
acauaccaggcccagaucag

SEQ ID NO: 17257 - RNA, 21 nt, Artificial Sequence
  Synthetic
cacauaccaggcccagaucag

SEQ ID NO: 17258 - RNA, 22 nt, Artificial Sequence
  Synthetic
ccacauaccaggcccagaucag

SEQ ID NO: 17259 - RNA, 23 nt, Artificial Sequence
  Synthetic
accacauaccaggcccagaucag

SEQ ID NO: 17260 - RNA, 24 nt, Artificial Sequence
  Synthetic
gaccacauaccaggcccagaucag

SEQ ID NO: 17261 - RNA, 18 nt, Artificial Sequence
  Synthetic
aaaggagaaauggaucag

SEQ ID NO: 17262 - RNA, 19 nt, Artificial Sequence
  Synthetic
caaaggagaaauggaucag

SEQ ID NO: 17263 - RNA, 20 nt, Artificial Sequence
  Synthetic
ucaaaggagaaauggaucag

SEQ ID NO: 17264 - RNA, 21 nt, Artificial Sequence
  Synthetic
aucaaaggagaaauggaucag

SEQ ID NO: 17265 - RNA, 22 nt, Artificial Sequence
  Synthetic
caucaaaggagaaauggaucag

SEQ ID NO: 17266 - RNA, 23 nt, Artificial Sequence
  Synthetic
ccaucaaaggagaaauggaucag

SEQ ID NO: 17267 - RNA, 24 nt, Artificial Sequence
  Synthetic
uccaucaaaggagaaauggaucag

SEQ ID NO: 17268 - RNA, 18 nt, Artificial Sequence
  Synthetic
aggcaauacagaccucag

SEQ ID NO: 17269 - RNA, 19 nt, Artificial Sequence
  Synthetic
aaggcaauacagaccucag

SEQ ID NO: 17270 - RNA, 20 nt, Artificial Sequence
  Synthetic
caaggcaauacagaccucag

SEQ ID NO: 17271 - RNA, 21 nt, Artificial Sequence
  Synthetic
gcaaggcaauacagaccucag

SEQ ID NO: 17272 - RNA, 22 nt, Artificial Sequence
  Synthetic
agcaaggcaauacagaccucag

SEQ ID NO: 17273 - RNA, 23 nt, Artificial Sequence
  Synthetic
gagcaaggcaauacagaccucag

SEQ ID NO: 17274 - RNA, 24 nt, Artificial Sequence
  Synthetic
agagcaaggcaauacagaccucag

SEQ ID NO: 17275 - RNA, 18 nt, Artificial Sequence
  Synthetic
uuuucaaacuguacagag

SEQ ID NO: 17276 - RNA, 19 nt, Artificial Sequence
  Synthetic
auuuucaaacuguacagag

SEQ ID NO: 17277 - RNA, 20 nt, Artificial Sequence
  Synthetic
aauuuucaaacuguacagag

SEQ ID NO: 17278 - RNA, 21 nt, Artificial Sequence
  Synthetic
uaauuuucaaacuguacagag

SEQ ID NO: 17279 - RNA, 22 nt, Artificial Sequence
  Synthetic
uuaauuuucaaacuguacagag

SEQ ID NO: 17280 - RNA, 23 nt, Artificial Sequence
  Synthetic
cuuaauuuucaaacuguacagag

SEQ ID NO: 17281 - RNA, 24 nt, Artificial Sequence
  Synthetic
ucuuaauuuucaaacuguacagag

SEQ ID NO: 17282 - RNA, 18 nt, Artificial Sequence
  Synthetic
guagagagaccaggagag

SEQ ID NO: 17283 - RNA, 19 nt, Artificial Sequence
  Synthetic
aguagagagaccaggagag

SEQ ID NO: 17284 - RNA, 20 nt, Artificial Sequence
  Synthetic
aaguagagagaccaggagag

SEQ ID NO: 17285 - RNA, 21 nt, Artificial Sequence
  Synthetic
gaaguagagagaccaggagag

SEQ ID NO: 17286 - RNA, 22 nt, Artificial Sequence
  Synthetic
ugaaguagagagaccaggagag

SEQ ID NO: 17287 - RNA, 23 nt, Artificial Sequence
  Synthetic
gugaaguagagagaccaggagag

SEQ ID NO: 17288 - RNA, 24 nt, Artificial Sequence
  Synthetic
agugaaguagagagaccaggagag

SEQ ID NO: 17289 - RNA, 18 nt, Artificial Sequence
  Synthetic
aucacuugaacccaggag

SEQ ID NO: 17290 - RNA, 19 nt, Artificial Sequence
  Synthetic
aaucacuugaacccaggag

SEQ ID NO: 17291 - RNA, 20 nt, Artificial Sequence
  Synthetic
gaaucacuugaacccaggag

SEQ ID NO: 17292 - RNA, 21 nt, Artificial Sequence
  Synthetic
agaaucacuugaacccaggag

SEQ ID NO: 17293 - RNA, 22 nt, Artificial Sequence
  Synthetic
gagaaucacuugaacccaggag

SEQ ID NO: 17294 - RNA, 23 nt, Artificial Sequence
  Synthetic
ggagaaucacuugaacccaggag

SEQ ID NO: 17295 - RNA, 24 nt, Artificial Sequence
  Synthetic
aggagaaucacuugaacccaggag

SEQ ID NO: 17296 - RNA, 18 nt, Artificial Sequence
  Synthetic
gaaaccauacuucaggag

SEQ ID NO: 17297 - RNA, 19 nt, Artificial Sequence
  Synthetic
ggaaaccauacuucaggag

SEQ ID NO: 17298 - RNA, 20 nt, Artificial Sequence
  Synthetic
uggaaaccauacuucaggag

SEQ ID NO: 17299 - RNA, 21 nt, Artificial Sequence
  Synthetic
guggaaaccauacuucaggag

SEQ ID NO: 17300 - RNA, 22 nt, Artificial Sequence
  Synthetic
gguggaaaccauacuucaggag

SEQ ID NO: 17301 - RNA, 23 nt, Artificial Sequence
  Synthetic
ugguggaaaccauacuucaggag

SEQ ID NO: 17302 - RNA, 24 nt, Artificial Sequence
  Synthetic
augguggaaaccauacuucaggag

SEQ ID NO: 17303 - RNA, 18 nt, Artificial Sequence
  Synthetic
augggguaguuaccugag

SEQ ID NO: 17304 - RNA, 19 nt, Artificial Sequence
  Synthetic
aaugggguaguuaccugag

SEQ ID NO: 17305 - RNA, 20 nt, Artificial Sequence
  Synthetic
gaaugggguaguuaccugag

SEQ ID NO: 17306 - RNA, 21 nt, Artificial Sequence
  Synthetic
agaaugggguaguuaccugag

SEQ ID NO: 17307 - RNA, 22 nt, Artificial Sequence
  Synthetic
uagaaugggguaguuaccugag

SEQ ID NO: 17308 - RNA, 23 nt, Artificial Sequence
  Synthetic
auagaaugggguaguuaccugag

SEQ ID NO: 17309 - RNA, 24 nt, Artificial Sequence
  Synthetic
aauagaaugggguaguuaccugag

SEQ ID NO: 17310 - RNA, 18 nt, Artificial Sequence
  Synthetic
ccacucagaguggcugag

SEQ ID NO: 17311 - RNA, 19 nt, Artificial Sequence
  Synthetic
uccacucagaguggcugag

SEQ ID NO: 17312 - RNA, 21 nt, Artificial Sequence
  Synthetic
uuuccacucagaguggcugag

SEQ ID NO: 17313 - RNA, 22 nt, Artificial Sequence
  Synthetic
cuuuccacucagaguggcugag

SEQ ID NO: 17314 - RNA, 23 nt, Artificial Sequence
  Synthetic
gcuuuccacucagaguggcugag

SEQ ID NO: 17315 - RNA, 24 nt, Artificial Sequence
  Synthetic
ugcuuuccacucagaguggcugag

SEQ ID NO: 17316 - RNA, 18 nt, Artificial Sequence
  Synthetic
ggcagaguuugcagugag

SEQ ID NO: 17317 - RNA, 19 nt, Artificial Sequence
  Synthetic
aggcagaguuugcagugag

SEQ ID NO: 17318 - RNA, 20 nt, Artificial Sequence
  Synthetic
gaggcagaguuugcagugag

SEQ ID NO: 17319 - RNA, 21 nt, Artificial Sequence
  Synthetic
ggaggcagaguuugcagugag

SEQ ID NO: 17320 - RNA, 22 nt, Artificial Sequence
  Synthetic
aggaggcagaguuugcagugag

SEQ ID NO: 17321 - RNA, 23 nt, Artificial Sequence
  Synthetic
caggaggcagaguuugcagugag

SEQ ID NO: 17322 - RNA, 24 nt, Artificial Sequence
  Synthetic
ccaggaggcagaguuugcagugag

SEQ ID NO: 17323 - RNA, 18 nt, Artificial Sequence
  Synthetic
uaggugaugugguucuag

SEQ ID NO: 17324 - RNA, 19 nt, Artificial Sequence
  Synthetic
guaggugaugugguucuag

SEQ ID NO: 17325 - RNA, 20 nt, Artificial Sequence
  Synthetic
aguaggugaugugguucuag

SEQ ID NO: 17326 - RNA, 21 nt, Artificial Sequence
  Synthetic
gaguaggugaugugguucuag

SEQ ID NO: 17327 - RNA, 22 nt, Artificial Sequence
  Synthetic
agaguaggugaugugguucuag

SEQ ID NO: 17328 - RNA, 23 nt, Artificial Sequence
  Synthetic
aagaguaggugaugugguucuag

SEQ ID NO: 17329 - RNA, 24 nt, Artificial Sequence
  Synthetic
caagaguaggugaugugguucuag

SEQ ID NO: 17330 - RNA, 18 nt, Artificial Sequence
  Synthetic
auuucaugaaccacaagg

SEQ ID NO: 17331 - RNA, 19 nt, Artificial Sequence
  Synthetic
aauuucaugaaccacaagg

SEQ ID NO: 17332 - RNA, 20 nt, Artificial Sequence
  Synthetic
aaauuucaugaaccacaagg

SEQ ID NO: 17333 - RNA, 21 nt, Artificial Sequence
  Synthetic
aaaauuucaugaaccacaagg

SEQ ID NO: 17334 - RNA, 22 nt, Artificial Sequence
  Synthetic
aaaaauuucaugaaccacaagg

SEQ ID NO: 17335 - RNA, 23 nt, Artificial Sequence
  Synthetic
gaaaaauuucaugaaccacaagg

SEQ ID NO: 17336 - RNA, 24 nt, Artificial Sequence
  Synthetic
ugaaaaauuucaugaaccacaagg

SEQ ID NO: 17337 - RNA, 18 nt, Artificial Sequence
  Synthetic
cagaugggaaagccaagg

SEQ ID NO: 17338 - RNA, 19 nt, Artificial Sequence
  Synthetic
ucagaugggaaagccaagg

SEQ ID NO: 17339 - RNA, 20 nt, Artificial Sequence
  Synthetic
aucagaugggaaagccaagg

SEQ ID NO: 17340 - RNA, 21 nt, Artificial Sequence
  Synthetic
gaucagaugggaaagccaagg

SEQ ID NO: 17341 - RNA, 22 nt, Artificial Sequence
  Synthetic
ggaucagaugggaaagccaagg

SEQ ID NO: 17342 - RNA, 23 nt, Artificial Sequence
  Synthetic
uggaucagaugggaaagccaagg

SEQ ID NO: 17343 - RNA, 24 nt, Artificial Sequence
  Synthetic
auggaucagaugggaaagccaagg

SEQ ID NO: 17344 - RNA, 18 nt, Artificial Sequence
  Synthetic
ccugaggagaaggcaagg

SEQ ID NO: 17345 - RNA, 19 nt, Artificial Sequence
  Synthetic
accugaggagaaggcaagg

SEQ ID NO: 17346 - RNA, 20 nt, Artificial Sequence
  Synthetic
uaccugaggagaaggcaagg

SEQ ID NO: 17347 - RNA, 21 nt, Artificial Sequence
  Synthetic
uuaccugaggagaaggcaagg

SEQ ID NO: 17348 - RNA, 22 nt, Artificial Sequence
  Synthetic
guuaccugaggagaaggcaagg

SEQ ID NO: 17349 - RNA, 23 nt, Artificial Sequence
  Synthetic
aguuaccugaggagaaggcaagg

SEQ ID NO: 17350 - RNA, 24 nt, Artificial Sequence
  Synthetic
uaguuaccugaggagaaggcaagg

SEQ ID NO: 17351 - RNA, 18 nt, Artificial Sequence
  Synthetic
aagaaaagaaguaacagg

SEQ ID NO: 17352 - RNA, 19 nt, Artificial Sequence
  Synthetic
uaagaaaagaaguaacagg

SEQ ID NO: 17353 - RNA, 20 nt, Artificial Sequence
  Synthetic
auaagaaaagaaguaacagg

SEQ ID NO: 17354 - RNA, 21 nt, Artificial Sequence
  Synthetic
uauaagaaaagaaguaacagg

SEQ ID NO: 17355 - RNA, 22 nt, Artificial Sequence
  Synthetic
uuauaagaaaagaaguaacagg

SEQ ID NO: 17356 - RNA, 23 nt, Artificial Sequence
  Synthetic
uuuauaagaaaagaaguaacagg

SEQ ID NO: 17357 - RNA, 24 nt, Artificial Sequence
  Synthetic
uuuuauaagaaaagaaguaacagg

SEQ ID NO: 17358 - RNA, 18 nt, Artificial Sequence
  Synthetic
acccagcuacucgagagg

SEQ ID NO: 17359 - RNA, 19 nt, Artificial Sequence
  Synthetic
aacccagcuacucgagagg

SEQ ID NO: 17360 - RNA, 20 nt, Artificial Sequence
  Synthetic
aaacccagcuacucgagagg

SEQ ID NO: 17361 - RNA, 21 nt, Artificial Sequence
  Synthetic
uaaacccagcuacucgagagg

SEQ ID NO: 17362 - RNA, 22 nt, Artificial Sequence
  Synthetic
guaaacccagcuacucgagagg

SEQ ID NO: 17363 - RNA, 23 nt, Artificial Sequence
  Synthetic
uguaaacccagcuacucgagagg

SEQ ID NO: 17364 - RNA, 24 nt, Artificial Sequence
  Synthetic
cuguaaacccagcuacucgagagg

SEQ ID NO: 17365 - RNA, 18 nt, Artificial Sequence
  Synthetic
cuacucgagaggcugagg

SEQ ID NO: 17366 - RNA, 19 nt, Artificial Sequence
  Synthetic
gcuacucgagaggcugagg

SEQ ID NO: 17367 - RNA, 20 nt, Artificial Sequence
  Synthetic
agcuacucgagaggcugagg

SEQ ID NO: 17368 - RNA, 21 nt, Artificial Sequence
  Synthetic
cagcuacucgagaggcugagg

SEQ ID NO: 17369 - RNA, 22 nt, Artificial Sequence
  Synthetic
ccagcuacucgagaggcugagg

SEQ ID NO: 17370 - RNA, 23 nt, Artificial Sequence
  Synthetic
cccagcuacucgagaggcugagg

SEQ ID NO: 17371 - RNA, 24 nt, Artificial Sequence
  Synthetic
acccagcuacucgagaggcugagg

SEQ ID NO: 17372 - RNA, 18 nt, Artificial Sequence
  Synthetic
cucuaaaggaguaauagg

SEQ ID NO: 17373 - RNA, 19 nt, Artificial Sequence
  Synthetic
acucuaaaggaguaauagg

SEQ ID NO: 17374 - RNA, 20 nt, Artificial Sequence
  Synthetic
cacucuaaaggaguaauagg

SEQ ID NO: 17375 - RNA, 21 nt, Artificial Sequence
  Synthetic
ucacucuaaaggaguaauagg

SEQ ID NO: 17376 - RNA, 22 nt, Artificial Sequence
  Synthetic
aucacucuaaaggaguaauagg

SEQ ID NO: 17377 - RNA, 23 nt, Artificial Sequence
  Synthetic
aaucacucuaaaggaguaauagg

SEQ ID NO: 17378 - RNA, 24 nt, Artificial Sequence
  Synthetic
aaaucacucuaaaggaguaauagg

SEQ ID NO: 17379 - RNA, 18 nt, Artificial Sequence
  Synthetic
aggcccagaucagaaggg

SEQ ID NO: 17380 - RNA, 19 nt, Artificial Sequence
  Synthetic
caggcccagaucagaaggg

SEQ ID NO: 17381 - RNA, 20 nt, Artificial Sequence
  Synthetic
ccaggcccagaucagaaggg

SEQ ID NO: 17382 - RNA, 21 nt, Artificial Sequence
  Synthetic
accaggcccagaucagaaggg

SEQ ID NO: 17383 - RNA, 22 nt, Artificial Sequence
  Synthetic
uaccaggcccagaucagaaggg

SEQ ID NO: 17384 - RNA, 23 nt, Artificial Sequence
  Synthetic
auaccaggcccagaucagaaggg

SEQ ID NO: 17385 - RNA, 24 nt, Artificial Sequence
  Synthetic
cauaccaggcccagaucagaaggg

SEQ ID NO: 17386 - RNA, 18 nt, Artificial Sequence
  Synthetic
agaaaagaaguaacaggg

SEQ ID NO: 17387 - RNA, 19 nt, Artificial Sequence
  Synthetic
aagaaaagaaguaacaggg

SEQ ID NO: 17388 - RNA, 21 nt, Artificial Sequence
  Synthetic
auaagaaaagaaguaacaggg

SEQ ID NO: 17389 - RNA, 22 nt, Artificial Sequence
  Synthetic
uauaagaaaagaaguaacaggg

SEQ ID NO: 17390 - RNA, 23 nt, Artificial Sequence
  Synthetic
uuauaagaaaagaaguaacaggg

SEQ ID NO: 17391 - RNA, 24 nt, Artificial Sequence
  Synthetic
uuuauaagaaaagaaguaacaggg

SEQ ID NO: 17392 - RNA, 18 nt, Artificial Sequence
  Synthetic
ugagagauucuuuauggg

SEQ ID NO: 17393 - RNA, 19 nt, Artificial Sequence
  Synthetic
cugagagauucuuuauggg

SEQ ID NO: 17394 - RNA, 21 nt, Artificial Sequence
  Synthetic
aacugagagauucuuuauggg

SEQ ID NO: 17395 - RNA, 22 nt, Artificial Sequence
  Synthetic
aaacugagagauucuuuauggg

SEQ ID NO: 17396 - RNA, 23 nt, Artificial Sequence
  Synthetic
gaaacugagagauucuuuauggg

SEQ ID NO: 17397 - RNA, 24 nt, Artificial Sequence
  Synthetic
ggaaacugagagauucuuuauggg

SEQ ID NO: 17398 - RNA, 18 nt, Artificial Sequence
  Synthetic
ggggaauuucuuuaaugg

SEQ ID NO: 17399 - RNA, 19 nt, Artificial Sequence
  Synthetic
cggggaauuucuuuaaugg

SEQ ID NO: 17400 - RNA, 20 nt, Artificial Sequence
  Synthetic
ucggggaauuucuuuaaugg

SEQ ID NO: 17401 - RNA, 21 nt, Artificial Sequence
  Synthetic
gucggggaauuucuuuaaugg

SEQ ID NO: 17402 - RNA, 22 nt, Artificial Sequence
  Synthetic
ggucggggaauuucuuuaaugg

SEQ ID NO: 17403 - RNA, 23 nt, Artificial Sequence
  Synthetic
aggucggggaauuucuuuaaugg

SEQ ID NO: 17404 - RNA, 24 nt, Artificial Sequence
  Synthetic
aaggucggggaauuucuuuaaugg

SEQ ID NO: 17405 - RNA, 18 nt, Artificial Sequence
  Synthetic
guaguuuuaggaacaugg

SEQ ID NO: 17406 - RNA, 19 nt, Artificial Sequence
  Synthetic
uguaguuuuaggaacaugg

SEQ ID NO: 17407 - RNA, 21 nt, Artificial Sequence
  Synthetic
aauguaguuuuaggaacaugg

SEQ ID NO: 17408 - RNA, 22 nt, Artificial Sequence
  Synthetic
caauguaguuuuaggaacaugg

SEQ ID NO: 17409 - RNA, 23 nt, Artificial Sequence
  Synthetic
gcaauguaguuuuaggaacaugg

SEQ ID NO: 17410 - RNA, 24 nt, Artificial Sequence
  Synthetic
ggcaauguaguuuuaggaacaugg

SEQ ID NO: 17411 - RNA, 18 nt, Artificial Sequence
  Synthetic
cugagagauucuuuaugg

SEQ ID NO: 17412 - RNA, 19 nt, Artificial Sequence
  Synthetic
acugagagauucuuuaugg

SEQ ID NO: 17413 - RNA, 21 nt, Artificial Sequence
  Synthetic
aaacugagagauucuuuaugg

SEQ ID NO: 17414 - RNA, 22 nt, Artificial Sequence
  Synthetic
gaaacugagagauucuuuaugg

SEQ ID NO: 17415 - RNA, 23 nt, Artificial Sequence
  Synthetic
ggaaacugagagauucuuuaugg

SEQ ID NO: 17416 - RNA, 24 nt, Artificial Sequence
  Synthetic
aggaaacugagagauucuuuaugg

SEQ ID NO: 17417 - RNA, 18 nt, Artificial Sequence
  Synthetic
aaauagucugaaaacugg

SEQ ID NO: 17418 - RNA, 19 nt, Artificial Sequence
  Synthetic
uaaauagucugaaaacugg

SEQ ID NO: 17419 - RNA, 20 nt, Artificial Sequence
  Synthetic
uuaaauagucugaaaacugg

SEQ ID NO: 17420 - RNA, 21 nt, Artificial Sequence
  Synthetic
auuaaauagucugaaaacugg

SEQ ID NO: 17421 - RNA, 22 nt, Artificial Sequence
  Synthetic
cauuaaauagucugaaaacugg

SEQ ID NO: 17422 - RNA, 23 nt, Artificial Sequence
  Synthetic
acauuaaauagucugaaaacugg

SEQ ID NO: 17423 - RNA, 24 nt, Artificial Sequence
  Synthetic
gacauuaaauagucugaaaacugg

SEQ ID NO: 17424 - RNA, 18 nt, Artificial Sequence
  Synthetic
gcuuuccacucagagugg

SEQ ID NO: 17425 - RNA, 19 nt, Artificial Sequence
  Synthetic
ugcuuuccacucagagugg

SEQ ID NO: 17426 - RNA, 20 nt, Artificial Sequence
  Synthetic
augcuuuccacucagagugg

SEQ ID NO: 17427 - RNA, 21 nt, Artificial Sequence
  Synthetic
gaugcuuuccacucagagugg

SEQ ID NO: 17428 - RNA, 22 nt, Artificial Sequence
  Synthetic
ugaugcuuuccacucagagugg

SEQ ID NO: 17429 - RNA, 23 nt, Artificial Sequence
  Synthetic
augaugcuuuccacucagagugg

SEQ ID NO: 17430 - RNA, 24 nt, Artificial Sequence
  Synthetic
aaugaugcuuuccacucagagugg

SEQ ID NO: 17431 - RNA, 18 nt, Artificial Sequence
  Synthetic
guccacacggaaguaaug

SEQ ID NO: 17432 - RNA, 19 nt, Artificial Sequence
  Synthetic
gguccacacggaaguaaug

SEQ ID NO: 17433 - RNA, 20 nt, Artificial Sequence
  Synthetic
ugguccacacggaaguaaug

SEQ ID NO: 17434 - RNA, 21 nt, Artificial Sequence
  Synthetic
gugguccacacggaaguaaug

SEQ ID NO: 17435 - RNA, 22 nt, Artificial Sequence
  Synthetic
agugguccacacggaaguaaug

SEQ ID NO: 17436 - RNA, 23 nt, Artificial Sequence
  Synthetic
aagugguccacacggaaguaaug

SEQ ID NO: 17437 - RNA, 24 nt, Artificial Sequence
  Synthetic
aaagugguccacacggaaguaaug

SEQ ID NO: 17438 - RNA, 18 nt, Artificial Sequence
  Synthetic
accagccuggccaacaug

SEQ ID NO: 17439 - RNA, 19 nt, Artificial Sequence
  Synthetic
gaccagccuggccaacaug

SEQ ID NO: 17440 - RNA, 20 nt, Artificial Sequence
  Synthetic
agaccagccuggccaacaug

SEQ ID NO: 17441 - RNA, 21 nt, Artificial Sequence
  Synthetic
aagaccagccuggccaacaug

SEQ ID NO: 17442 - RNA, 22 nt, Artificial Sequence
  Synthetic
caagaccagccuggccaacaug

SEQ ID NO: 17443 - RNA, 23 nt, Artificial Sequence
  Synthetic
ucaagaccagccuggccaacaug

SEQ ID NO: 17444 - RNA, 24 nt, Artificial Sequence
  Synthetic
uucaagaccagccuggccaacaug

SEQ ID NO: 17445 - RNA, 18 nt, Artificial Sequence
  Synthetic
uguaguuuuaggaacaug

SEQ ID NO: 17446 - RNA, 19 nt, Artificial Sequence
  Synthetic
auguaguuuuaggaacaug

SEQ ID NO: 17447 - RNA, 20 nt, Artificial Sequence
  Synthetic
aauguaguuuuaggaacaug

SEQ ID NO: 17448 - RNA, 21 nt, Artificial Sequence
  Synthetic
caauguaguuuuaggaacaug

SEQ ID NO: 17449 - RNA, 22 nt, Artificial Sequence
  Synthetic
gcaauguaguuuuaggaacaug

SEQ ID NO: 17450 - RNA, 23 nt, Artificial Sequence
  Synthetic
ggcaauguaguuuuaggaacaug

SEQ ID NO: 17451 - RNA, 24 nt, Artificial Sequence
  Synthetic
gggcaauguaguuuuaggaacaug

SEQ ID NO: 17452 - RNA, 18 nt, Artificial Sequence
  Synthetic
uugcacacugcaguuaug

SEQ ID NO: 17453 - RNA, 19 nt, Artificial Sequence
  Synthetic
uuugcacacugcaguuaug

SEQ ID NO: 17454 - RNA, 20 nt, Artificial Sequence
  Synthetic
guuugcacacugcaguuaug

SEQ ID NO: 17455 - RNA, 21 nt, Artificial Sequence
  Synthetic
gguuugcacacugcaguuaug

SEQ ID NO: 17456 - RNA, 22 nt, Artificial Sequence
  Synthetic
ugguuugcacacugcaguuaug

SEQ ID NO: 17457 - RNA, 23 nt, Artificial Sequence
  Synthetic
gugguuugcacacugcaguuaug

SEQ ID NO: 17458 - RNA, 24 nt, Artificial Sequence
  Synthetic
ugugguuugcacacugcaguuaug

SEQ ID NO: 17459 - RNA, 18 nt, Artificial Sequence
  Synthetic
ccagggacccacuuuaug

SEQ ID NO: 17460 - RNA, 19 nt, Artificial Sequence
  Synthetic
accagggacccacuuuaug

SEQ ID NO: 17461 - RNA, 20 nt, Artificial Sequence
  Synthetic
aaccagggacccacuuuaug

SEQ ID NO: 17462 - RNA, 21 nt, Artificial Sequence
  Synthetic
uaaccagggacccacuuuaug

SEQ ID NO: 17463 - RNA, 22 nt, Artificial Sequence
  Synthetic
cuaaccagggacccacuuuaug

SEQ ID NO: 17464 - RNA, 23 nt, Artificial Sequence
  Synthetic
ucuaaccagggacccacuuuaug

SEQ ID NO: 17465 - RNA, 24 nt, Artificial Sequence
  Synthetic
uucuaaccagggacccacuuuaug

SEQ ID NO: 17466 - RNA, 18 nt, Artificial Sequence
  Synthetic
acugagagauucuuuaug

SEQ ID NO: 17467 - RNA, 19 nt, Artificial Sequence
  Synthetic
aacugagagauucuuuaug

SEQ ID NO: 17468 - RNA, 21 nt, Artificial Sequence
  Synthetic
gaaacugagagauucuuuaug

SEQ ID NO: 17469 - RNA, 22 nt, Artificial Sequence
  Synthetic
ggaaacugagagauucuuuaug

SEQ ID NO: 17470 - RNA, 23 nt, Artificial Sequence
  Synthetic
aggaaacugagagauucuuuaug

SEQ ID NO: 17471 - RNA, 24 nt, Artificial Sequence
  Synthetic
aaggaaacugagagauucuuuaug

SEQ ID NO: 17472 - RNA, 18 nt, Artificial Sequence
  Synthetic
gaaugggguaguuaccug

SEQ ID NO: 17473 - RNA, 19 nt, Artificial Sequence
  Synthetic
agaaugggguaguuaccug

SEQ ID NO: 17474 - RNA, 21 nt, Artificial Sequence
  Synthetic
auagaaugggguaguuaccug

SEQ ID NO: 17475 - RNA, 22 nt, Artificial Sequence
  Synthetic
aauagaaugggguaguuaccug

SEQ ID NO: 17476 - RNA, 23 nt, Artificial Sequence
  Synthetic
aaauagaaugggguaguuaccug

SEQ ID NO: 17477 - RNA, 24 nt, Artificial Sequence
  Synthetic
aaaauagaaugggguaguuaccug

SEQ ID NO: 17478 - RNA, 18 nt, Artificial Sequence
  Synthetic
ggucacuucccaagggug

SEQ ID NO: 17479 - RNA, 19 nt, Artificial Sequence
  Synthetic
gggucacuucccaagggug

SEQ ID NO: 17480 - RNA, 20 nt, Artificial Sequence
  Synthetic
agggucacuucccaagggug

SEQ ID NO: 17481 - RNA, 21 nt, Artificial Sequence
  Synthetic
cagggucacuucccaagggug

SEQ ID NO: 17482 - RNA, 22 nt, Artificial Sequence
  Synthetic
ccagggucacuucccaagggug

SEQ ID NO: 17483 - RNA, 23 nt, Artificial Sequence
  Synthetic
gccagggucacuucccaagggug

SEQ ID NO: 17484 - RNA, 24 nt, Artificial Sequence
  Synthetic
agccagggucacuucccaagggug

SEQ ID NO: 17485 - RNA, 18 nt, Artificial Sequence
  Synthetic
uaaaggucuuugaaaaau

SEQ ID NO: 17486 - RNA, 19 nt, Artificial Sequence
  Synthetic
uuaaaggucuuugaaaaau

SEQ ID NO: 17487 - RNA, 20 nt, Artificial Sequence
  Synthetic
auuaaaggucuuugaaaaau

SEQ ID NO: 17488 - RNA, 21 nt, Artificial Sequence
  Synthetic
uauuaaaggucuuugaaaaau

SEQ ID NO: 17489 - RNA, 22 nt, Artificial Sequence
  Synthetic
guauuaaaggucuuugaaaaau

SEQ ID NO: 17490 - RNA, 23 nt, Artificial Sequence
  Synthetic
uguauuaaaggucuuugaaaaau

SEQ ID NO: 17491 - RNA, 24 nt, Artificial Sequence
  Synthetic
auguauuaaaggucuuugaaaaau

SEQ ID NO: 17492 - RNA, 18 nt, Artificial Sequence
  Synthetic
acaaggcaguuaugaaau

SEQ ID NO: 17493 - RNA, 19 nt, Artificial Sequence
  Synthetic
cacaaggcaguuaugaaau

SEQ ID NO: 17494 - RNA, 20 nt, Artificial Sequence
  Synthetic
ucacaaggcaguuaugaaau

SEQ ID NO: 17495 - RNA, 21 nt, Artificial Sequence
  Synthetic
gucacaaggcaguuaugaaau

SEQ ID NO: 17496 - RNA, 22 nt, Artificial Sequence
  Synthetic
ggucacaaggcaguuaugaaau

SEQ ID NO: 17497 - RNA, 23 nt, Artificial Sequence
  Synthetic
uggucacaaggcaguuaugaaau

SEQ ID NO: 17498 - RNA, 24 nt, Artificial Sequence
  Synthetic
auggucacaaggcaguuaugaaau

SEQ ID NO: 17499 - RNA, 18 nt, Artificial Sequence
  Synthetic
cagaguaagaagcuaaau

SEQ ID NO: 17500 - RNA, 19 nt, Artificial Sequence
  Synthetic
ucagaguaagaagcuaaau

SEQ ID NO: 17501 - RNA, 20 nt, Artificial Sequence
  Synthetic
cucagaguaagaagcuaaau

SEQ ID NO: 17502 - RNA, 21 nt, Artificial Sequence
  Synthetic
acucagaguaagaagcuaaau

SEQ ID NO: 17503 - RNA, 22 nt, Artificial Sequence
  Synthetic
uacucagaguaagaagcuaaau

SEQ ID NO: 17504 - RNA, 23 nt, Artificial Sequence
  Synthetic
uuacucagaguaagaagcuaaau

SEQ ID NO: 17505 - RNA, 24 nt, Artificial Sequence
  Synthetic
guuacucagaguaagaagcuaaau

SEQ ID NO: 17506 - RNA, 18 nt, Artificial Sequence
  Synthetic
caacaaaauggguucaau

SEQ ID NO: 17507 - RNA, 19 nt, Artificial Sequence
  Synthetic
ccaacaaaauggguucaau

SEQ ID NO: 17508 - RNA, 20 nt, Artificial Sequence
  Synthetic
accaacaaaauggguucaau

SEQ ID NO: 17509 - RNA, 21 nt, Artificial Sequence
  Synthetic
aaccaacaaaauggguucaau

SEQ ID NO: 17510 - RNA, 22 nt, Artificial Sequence
  Synthetic
aaaccaacaaaauggguucaau

SEQ ID NO: 17511 - RNA, 23 nt, Artificial Sequence
  Synthetic
uaaaccaacaaaauggguucaau

SEQ ID NO: 17512 - RNA, 24 nt, Artificial Sequence
  Synthetic
auaaaccaacaaaauggguucaau

SEQ ID NO: 17513 - RNA, 18 nt, Artificial Sequence
  Synthetic
cccuagaagcuugcuaau

SEQ ID NO: 17514 - RNA, 19 nt, Artificial Sequence
  Synthetic
ccccuagaagcuugcuaau

SEQ ID NO: 17515 - RNA, 20 nt, Artificial Sequence
  Synthetic
uccccuagaagcuugcuaau

SEQ ID NO: 17516 - RNA, 21 nt, Artificial Sequence
  Synthetic
auccccuagaagcuugcuaau

SEQ ID NO: 17517 - RNA, 22 nt, Artificial Sequence
  Synthetic
cauccccuagaagcuugcuaau

SEQ ID NO: 17518 - RNA, 23 nt, Artificial Sequence
  Synthetic
gcauccccuagaagcuugcuaau

SEQ ID NO: 17519 - RNA, 24 nt, Artificial Sequence
  Synthetic
ggcauccccuagaagcuugcuaau

SEQ ID NO: 17520 - RNA, 18 nt, Artificial Sequence
  Synthetic
uuuaaauugaaucaacau

SEQ ID NO: 17521 - RNA, 19 nt, Artificial Sequence
  Synthetic
uuuuaaauugaaucaacau

SEQ ID NO: 17522 - RNA, 21 nt, Artificial Sequence
  Synthetic
uuuuuuaaauugaaucaacau

SEQ ID NO: 17523 - RNA, 22 nt, Artificial Sequence
  Synthetic
auuuuuuaaauugaaucaacau

SEQ ID NO: 17524 - RNA, 23 nt, Artificial Sequence
  Synthetic
uauuuuuuaaauugaaucaacau

SEQ ID NO: 17525 - RNA, 24 nt, Artificial Sequence
  Synthetic
auauuuuuuaaauugaaucaacau

SEQ ID NO: 17526 - RNA, 18 nt, Artificial Sequence
  Synthetic
gguguuguuauauuucau

SEQ ID NO: 17527 - RNA, 19 nt, Artificial Sequence
  Synthetic
agguguuguuauauuucau

SEQ ID NO: 17528 - RNA, 20 nt, Artificial Sequence
  Synthetic
aagguguuguuauauuucau

SEQ ID NO: 17529 - RNA, 21 nt, Artificial Sequence
  Synthetic
aaagguguuguuauauuucau

SEQ ID NO: 17530 - RNA, 22 nt, Artificial Sequence
  Synthetic
gaaagguguuguuauauuucau

SEQ ID NO: 17531 - RNA, 23 nt, Artificial Sequence
  Synthetic
agaaagguguuguuauauuucau

SEQ ID NO: 17532 - RNA, 24 nt, Artificial Sequence
  Synthetic
uagaaagguguuguuauauuucau

SEQ ID NO: 17533 - RNA, 18 nt, Artificial Sequence
  Synthetic
uucgugguccuuaaagau

SEQ ID NO: 17534 - RNA, 19 nt, Artificial Sequence
  Synthetic
uuucgugguccuuaaagau

SEQ ID NO: 17535 - RNA, 21 nt, Artificial Sequence
  Synthetic
ucuuucgugguccuuaaagau

SEQ ID NO: 17536 - RNA, 22 nt, Artificial Sequence
  Synthetic
uucuuucgugguccuuaaagau

SEQ ID NO: 17537 - RNA, 23 nt, Artificial Sequence
  Synthetic
cuucuuucgugguccuuaaagau

SEQ ID NO: 17538 - RNA, 24 nt, Artificial Sequence
  Synthetic
ccuucuuucgugguccuuaaagau

SEQ ID NO: 17539 - RNA, 18 nt, Artificial Sequence
  Synthetic
cacauaccaggcccagau

SEQ ID NO: 17540 - RNA, 19 nt, Artificial Sequence
  Synthetic
ccacauaccaggcccagau

SEQ ID NO: 17541 - RNA, 20 nt, Artificial Sequence
  Synthetic
accacauaccaggcccagau

SEQ ID NO: 17542 - RNA, 21 nt, Artificial Sequence
  Synthetic
gaccacauaccaggcccagau

SEQ ID NO: 17543 - RNA, 22 nt, Artificial Sequence
  Synthetic
ggaccacauaccaggcccagau

SEQ ID NO: 17544 - RNA, 23 nt, Artificial Sequence
  Synthetic
aggaccacauaccaggcccagau

SEQ ID NO: 17545 - RNA, 24 nt, Artificial Sequence
  Synthetic
uaggaccacauaccaggcccagau

SEQ ID NO: 17546 - RNA, 18 nt, Artificial Sequence
  Synthetic
aggagaaauggaucagau

SEQ ID NO: 17547 - RNA, 19 nt, Artificial Sequence
  Synthetic
aaggagaaauggaucagau

SEQ ID NO: 17548 - RNA, 21 nt, Artificial Sequence
  Synthetic
caaaggagaaauggaucagau

SEQ ID NO: 17549 - RNA, 22 nt, Artificial Sequence
  Synthetic
ucaaaggagaaauggaucagau

SEQ ID NO: 17550 - RNA, 23 nt, Artificial Sequence
  Synthetic
aucaaaggagaaauggaucagau

SEQ ID NO: 17551 - RNA, 24 nt, Artificial Sequence
  Synthetic
caucaaaggagaaauggaucagau

SEQ ID NO: 17552 - RNA, 18 nt, Artificial Sequence
  Synthetic
guaauacacagcugagau

SEQ ID NO: 17553 - RNA, 19 nt, Artificial Sequence
  Synthetic
aguaauacacagcugagau

SEQ ID NO: 17554 - RNA, 20 nt, Artificial Sequence
  Synthetic
gaguaauacacagcugagau

SEQ ID NO: 17555 - RNA, 21 nt, Artificial Sequence
  Synthetic
ggaguaauacacagcugagau

SEQ ID NO: 17556 - RNA, 22 nt, Artificial Sequence
  Synthetic
aggaguaauacacagcugagau

SEQ ID NO: 17557 - RNA, 23 nt, Artificial Sequence
  Synthetic
aaggaguaauacacagcugagau

SEQ ID NO: 17558 - RNA, 24 nt, Artificial Sequence
  Synthetic
aaaggaguaauacacagcugagau

SEQ ID NO: 17559 - RNA, 18 nt, Artificial Sequence
  Synthetic
ggauccuaaccuuuugau

SEQ ID NO: 17560 - RNA, 19 nt, Artificial Sequence
  Synthetic
aggauccuaaccuuuugau

SEQ ID NO: 17561 - RNA, 21 nt, Artificial Sequence
  Synthetic
aaaggauccuaaccuuuugau

SEQ ID NO: 17562 - RNA, 22 nt, Artificial Sequence
  Synthetic
aaaaggauccuaaccuuuugau

SEQ ID NO: 17563 - RNA, 23 nt, Artificial Sequence
  Synthetic
caaaaggauccuaaccuuuugau

SEQ ID NO: 17564 - RNA, 24 nt, Artificial Sequence
  Synthetic
ucaaaaggauccuaaccuuuugau

SEQ ID NO: 17565 - RNA, 18 nt, Artificial Sequence
  Synthetic
uuuucuuuuaaauacuau

SEQ ID NO: 17566 - RNA, 19 nt, Artificial Sequence
  Synthetic
guuuucuuuuaaauacuau

SEQ ID NO: 17567 - RNA, 21 nt, Artificial Sequence
  Synthetic
cuguuuucuuuuaaauacuau

SEQ ID NO: 17568 - RNA, 22 nt, Artificial Sequence
  Synthetic
ucuguuuucuuuuaaauacuau

SEQ ID NO: 17569 - RNA, 23 nt, Artificial Sequence
  Synthetic
uucuguuuucuuuuaaauacuau

SEQ ID NO: 17570 - RNA, 24 nt, Artificial Sequence
  Synthetic
uuucuguuuucuuuuaaauacuau

SEQ ID NO: 17571 - RNA, 18 nt, Artificial Sequence
  Synthetic
aacugagagauucuuuau

SEQ ID NO: 17572 - RNA, 19 nt, Artificial Sequence
  Synthetic
aaacugagagauucuuuau

SEQ ID NO: 17573 - RNA, 21 nt, Artificial Sequence
  Synthetic
ggaaacugagagauucuuuau

SEQ ID NO: 17574 - RNA, 22 nt, Artificial Sequence
  Synthetic
aggaaacugagagauucuuuau

SEQ ID NO: 17575 - RNA, 23 nt, Artificial Sequence
  Synthetic
aaggaaacugagagauucuuuau

SEQ ID NO: 17576 - RNA, 24 nt, Artificial Sequence
  Synthetic
aaaggaaacugagagauucuuuau

SEQ ID NO: 17577 - RNA, 18 nt, Artificial Sequence
  Synthetic
uucaaauaccaauuuuau

SEQ ID NO: 17578 - RNA, 19 nt, Artificial Sequence
  Synthetic
uuucaaauaccaauuuuau

SEQ ID NO: 17579 - RNA, 20 nt, Artificial Sequence
  Synthetic
auuucaaauaccaauuuuau

SEQ ID NO: 17580 - RNA, 21 nt, Artificial Sequence
  Synthetic
aauuucaaauaccaauuuuau

SEQ ID NO: 17581 - RNA, 22 nt, Artificial Sequence
  Synthetic
aaauuucaaauaccaauuuuau

SEQ ID NO: 17582 - RNA, 23 nt, Artificial Sequence
  Synthetic
uaaauuucaaauaccaauuuuau

SEQ ID NO: 17583 - RNA, 24 nt, Artificial Sequence
  Synthetic
auaaauuucaaauaccaauuuuau

SEQ ID NO: 17584 - RNA, 18 nt, Artificial Sequence
  Synthetic
uugauuggaaaggaaacu

SEQ ID NO: 17585 - RNA, 19 nt, Artificial Sequence
  Synthetic
uuugauuggaaaggaaacu

SEQ ID NO: 17586 - RNA, 20 nt, Artificial Sequence
  Synthetic
uuuugauuggaaaggaaacu

SEQ ID NO: 17587 - RNA, 21 nt, Artificial Sequence
  Synthetic
cuuuugauuggaaaggaaacu

SEQ ID NO: 17588 - RNA, 22 nt, Artificial Sequence
  Synthetic
ccuuuugauuggaaaggaaacu

SEQ ID NO: 17589 - RNA, 23 nt, Artificial Sequence
  Synthetic
accuuuugauuggaaaggaaacu

SEQ ID NO: 17590 - RNA, 24 nt, Artificial Sequence
  Synthetic
aaccuuuugauuggaaaggaaacu

SEQ ID NO: 17591 - RNA, 18 nt, Artificial Sequence
  Synthetic
gccacuaaucccaacacu

SEQ ID NO: 17592 - RNA, 19 nt, Artificial Sequence
  Synthetic
cgccacuaaucccaacacu

SEQ ID NO: 17593 - RNA, 20 nt, Artificial Sequence
  Synthetic
acgccacuaaucccaacacu

SEQ ID NO: 17594 - RNA, 21 nt, Artificial Sequence
  Synthetic
cacgccacuaaucccaacacu

SEQ ID NO: 17595 - RNA, 22 nt, Artificial Sequence
  Synthetic
ucacgccacuaaucccaacacu

SEQ ID NO: 17596 - RNA, 23 nt, Artificial Sequence
  Synthetic
cucacgccacuaaucccaacacu

SEQ ID NO: 17597 - RNA, 24 nt, Artificial Sequence
  Synthetic
gcucacgccacuaaucccaacacu

SEQ ID NO: 17598 - RNA, 18 nt, Artificial Sequence
  Synthetic
ggcccuauucuaggcacu

SEQ ID NO: 17599 - RNA, 19 nt, Artificial Sequence
  Synthetic
aggcccuauucuaggcacu

SEQ ID NO: 17600 - RNA, 21 nt, Artificial Sequence
  Synthetic
ccaggcccuauucuaggcacu

SEQ ID NO: 17601 - RNA, 22 nt, Artificial Sequence
  Synthetic
gccaggcccuauucuaggcacu

SEQ ID NO: 17602 - RNA, 23 nt, Artificial Sequence
  Synthetic
ugccaggcccuauucuaggcacu

SEQ ID NO: 17603 - RNA, 24 nt, Artificial Sequence
  Synthetic
augccaggcccuauucuaggcacu

SEQ ID NO: 17604 - RNA, 18 nt, Artificial Sequence
  Synthetic
ccuguagucccagcuacu

SEQ ID NO: 17605 - RNA, 19 nt, Artificial Sequence
  Synthetic
gccuguagucccagcuacu

SEQ ID NO: 17606 - RNA, 20 nt, Artificial Sequence
  Synthetic
ugccuguagucccagcuacu

SEQ ID NO: 17607 - RNA, 21 nt, Artificial Sequence
  Synthetic
augccuguagucccagcuacu

SEQ ID NO: 17608 - RNA, 22 nt, Artificial Sequence
  Synthetic
caugccuguagucccagcuacu

SEQ ID NO: 17609 - RNA, 23 nt, Artificial Sequence
  Synthetic
gcaugccuguagucccagcuacu

SEQ ID NO: 17610 - RNA, 24 nt, Artificial Sequence
  Synthetic
ugcaugccuguagucccagcuacu

SEQ ID NO: 17611 - RNA, 18 nt, Artificial Sequence
  Synthetic
agaaugggguaguuaccu

SEQ ID NO: 17612 - RNA, 19 nt, Artificial Sequence
  Synthetic
uagaaugggguaguuaccu

SEQ ID NO: 17613 - RNA, 20 nt, Artificial Sequence
  Synthetic
auagaaugggguaguuaccu

SEQ ID NO: 17614 - RNA, 21 nt, Artificial Sequence
  Synthetic
aauagaaugggguaguuaccu

SEQ ID NO: 17615 - RNA, 22 nt, Artificial Sequence
  Synthetic
aaauagaaugggguaguuaccu

SEQ ID NO: 17616 - RNA, 23 nt, Artificial Sequence
  Synthetic
aaaauagaaugggguaguuaccu

SEQ ID NO: 17617 - RNA, 24 nt, Artificial Sequence
  Synthetic
aaaaauagaaugggguaguuaccu

SEQ ID NO: 17618 - RNA, 18 nt, Artificial Sequence
  Synthetic
gagcagagaauguuagcu

SEQ ID NO: 17619 - RNA, 19 nt, Artificial Sequence
  Synthetic
agagcagagaauguuagcu

SEQ ID NO: 17620 - RNA, 20 nt, Artificial Sequence
  Synthetic
gagagcagagaauguuagcu

SEQ ID NO: 17621 - RNA, 21 nt, Artificial Sequence
  Synthetic
ggagagcagagaauguuagcu

SEQ ID NO: 17622 - RNA, 22 nt, Artificial Sequence
  Synthetic
aggagagcagagaauguuagcu

SEQ ID NO: 17623 - RNA, 23 nt, Artificial Sequence
  Synthetic
caggagagcagagaauguuagcu

SEQ ID NO: 17624 - RNA, 24 nt, Artificial Sequence
  Synthetic
ccaggagagcagagaauguuagcu

SEQ ID NO: 17625 - RNA, 18 nt, Artificial Sequence
  Synthetic
uuuccacucagaguggcu

SEQ ID NO: 17626 - RNA, 19 nt, Artificial Sequence
  Synthetic
cuuuccacucagaguggcu

SEQ ID NO: 17627 - RNA, 20 nt, Artificial Sequence
  Synthetic
gcuuuccacucagaguggcu

SEQ ID NO: 17628 - RNA, 21 nt, Artificial Sequence
  Synthetic
ugcuuuccacucagaguggcu

SEQ ID NO: 17629 - RNA, 22 nt, Artificial Sequence
  Synthetic
augcuuuccacucagaguggcu

SEQ ID NO: 17630 - RNA, 23 nt, Artificial Sequence
  Synthetic
gaugcuuuccacucagaguggcu

SEQ ID NO: 17631 - RNA, 24 nt, Artificial Sequence
  Synthetic
ugaugcuuuccacucagaguggcu

SEQ ID NO: 17632 - RNA, 18 nt, Artificial Sequence
  Synthetic
auauccugacuacaaucu

SEQ ID NO: 17633 - RNA, 19 nt, Artificial Sequence
  Synthetic
cauauccugacuacaaucu

SEQ ID NO: 17634 - RNA, 21 nt, Artificial Sequence
  Synthetic
uucauauccugacuacaaucu

SEQ ID NO: 17635 - RNA, 22 nt, Artificial Sequence
  Synthetic
guucauauccugacuacaaucu

SEQ ID NO: 17636 - RNA, 23 nt, Artificial Sequence
  Synthetic
aguucauauccugacuacaaucu

SEQ ID NO: 17637 - RNA, 24 nt, Artificial Sequence
  Synthetic
aaguucauauccugacuacaaucu

SEQ ID NO: 17638 - RNA, 18 nt, Artificial Sequence
  Synthetic
gaagcuggcccuugaucu

SEQ ID NO: 17639 - RNA, 19 nt, Artificial Sequence
  Synthetic
agaagcuggcccuugaucu

SEQ ID NO: 17640 - RNA, 20 nt, Artificial Sequence
  Synthetic
uagaagcuggcccuugaucu

SEQ ID NO: 17641 - RNA, 21 nt, Artificial Sequence
  Synthetic
auagaagcuggcccuugaucu

SEQ ID NO: 17642 - RNA, 22 nt, Artificial Sequence
  Synthetic
aauagaagcuggcccuugaucu

SEQ ID NO: 17643 - RNA, 23 nt, Artificial Sequence
  Synthetic
uaauagaagcuggcccuugaucu

SEQ ID NO: 17644 - RNA, 24 nt, Artificial Sequence
  Synthetic
auaauagaagcuggcccuugaucu

SEQ ID NO: 17645 - RNA, 18 nt, Artificial Sequence
  Synthetic
gcaaaguauauuaucucu

SEQ ID NO: 17646 - RNA, 19 nt, Artificial Sequence
  Synthetic
ggcaaaguauauuaucucu

SEQ ID NO: 17647 - RNA, 20 nt, Artificial Sequence
  Synthetic
uggcaaaguauauuaucucu

SEQ ID NO: 17648 - RNA, 21 nt, Artificial Sequence
  Synthetic
cuggcaaaguauauuaucucu

SEQ ID NO: 17649 - RNA, 22 nt, Artificial Sequence
  Synthetic
acuggcaaaguauauuaucucu

SEQ ID NO: 17650 - RNA, 23 nt, Artificial Sequence
  Synthetic
aacuggcaaaguauauuaucucu

SEQ ID NO: 17651 - RNA, 24 nt, Artificial Sequence
  Synthetic
uaacuggcaaaguauauuaucucu

SEQ ID NO: 17652 - RNA, 18 nt, Artificial Sequence
  Synthetic
acuaugacucaagagucu

SEQ ID NO: 17653 - RNA, 19 nt, Artificial Sequence
  Synthetic
cacuaugacucaagagucu

SEQ ID NO: 17654 - RNA, 20 nt, Artificial Sequence
  Synthetic
gcacuaugacucaagagucu

SEQ ID NO: 17655 - RNA, 21 nt, Artificial Sequence
  Synthetic
agcacuaugacucaagagucu

SEQ ID NO: 17656 - RNA, 22 nt, Artificial Sequence
  Synthetic
aagcacuaugacucaagagucu

SEQ ID NO: 17657 - RNA, 23 nt, Artificial Sequence
  Synthetic
uaagcacuaugacucaagagucu

SEQ ID NO: 17658 - RNA, 24 nt, Artificial Sequence
  Synthetic
guaagcacuaugacucaagagucu

SEQ ID NO: 17659 - RNA, 18 nt, Artificial Sequence
  Synthetic
aucauguauuaaaggucu

SEQ ID NO: 17660 - RNA, 19 nt, Artificial Sequence
  Synthetic
aaucauguauuaaaggucu

SEQ ID NO: 17661 - RNA, 20 nt, Artificial Sequence
  Synthetic
aaaucauguauuaaaggucu

SEQ ID NO: 17662 - RNA, 21 nt, Artificial Sequence
  Synthetic
aaaaucauguauuaaaggucu

SEQ ID NO: 17663 - RNA, 22 nt, Artificial Sequence
  Synthetic
uaaaaucauguauuaaaggucu

SEQ ID NO: 17664 - RNA, 23 nt, Artificial Sequence
  Synthetic
cuaaaaucauguauuaaaggucu

SEQ ID NO: 17665 - RNA, 24 nt, Artificial Sequence
  Synthetic
acuaaaaucauguauuaaaggucu

SEQ ID NO: 17666 - RNA, 18 nt, Artificial Sequence
  Synthetic
agaaagcugguccggucu

SEQ ID NO: 17667 - RNA, 19 nt, Artificial Sequence
  Synthetic
uagaaagcugguccggucu

SEQ ID NO: 17668 - RNA, 20 nt, Artificial Sequence
  Synthetic
guagaaagcugguccggucu

SEQ ID NO: 17669 - RNA, 21 nt, Artificial Sequence
  Synthetic
uguagaaagcugguccggucu

SEQ ID NO: 17670 - RNA, 22 nt, Artificial Sequence
  Synthetic
auguagaaagcugguccggucu

SEQ ID NO: 17671 - RNA, 23 nt, Artificial Sequence
  Synthetic
uauguagaaagcugguccggucu

SEQ ID NO: 17672 - RNA, 24 nt, Artificial Sequence
  Synthetic
uuauguagaaagcugguccggucu

SEQ ID NO: 17673 - RNA, 18 nt, Artificial Sequence
  Synthetic
ucuaauaagacaaauucu

SEQ ID NO: 17674 - RNA, 19 nt, Artificial Sequence
  Synthetic
cucuaauaagacaaauucu

SEQ ID NO: 17675 - RNA, 20 nt, Artificial Sequence
  Synthetic
ucucuaauaagacaaauucu

SEQ ID NO: 17676 - RNA, 21 nt, Artificial Sequence
  Synthetic
gucucuaauaagacaaauucu

SEQ ID NO: 17677 - RNA, 22 nt, Artificial Sequence
  Synthetic
ggucucuaauaagacaaauucu

SEQ ID NO: 17678 - RNA, 23 nt, Artificial Sequence
  Synthetic
uggucucuaauaagacaaauucu

SEQ ID NO: 17679 - RNA, 24 nt, Artificial Sequence
  Synthetic
auggucucuaauaagacaaauucu

SEQ ID NO: 17680 - RNA, 18 nt, Artificial Sequence
  Synthetic
cauuugguuacucagagu

SEQ ID NO: 17681 - RNA, 19 nt, Artificial Sequence
  Synthetic
acauuugguuacucagagu

SEQ ID NO: 17682 - RNA, 20 nt, Artificial Sequence
  Synthetic
aacauuugguuacucagagu

SEQ ID NO: 17683 - RNA, 21 nt, Artificial Sequence
  Synthetic
uaacauuugguuacucagagu

SEQ ID NO: 17684 - RNA, 22 nt, Artificial Sequence
  Synthetic
auaacauuugguuacucagagu

SEQ ID NO: 17685 - RNA, 23 nt, Artificial Sequence
  Synthetic
cauaacauuugguuacucagagu

SEQ ID NO: 17686 - RNA, 24 nt, Artificial Sequence
  Synthetic
ccauaacauuugguuacucagagu

SEQ ID NO: 17687 - RNA, 18 nt, Artificial Sequence
  Synthetic
gaauagacauuaaauagu

SEQ ID NO: 17688 - RNA, 19 nt, Artificial Sequence
  Synthetic
agaauagacauuaaauagu

SEQ ID NO: 17689 - RNA, 20 nt, Artificial Sequence
  Synthetic
aagaauagacauuaaauagu

SEQ ID NO: 17690 - RNA, 21 nt, Artificial Sequence
  Synthetic
uaagaauagacauuaaauagu

SEQ ID NO: 17691 - RNA, 22 nt, Artificial Sequence
  Synthetic
guaagaauagacauuaaauagu

SEQ ID NO: 17692 - RNA, 23 nt, Artificial Sequence
  Synthetic
aguaagaauagacauuaaauagu

SEQ ID NO: 17693 - RNA, 24 nt, Artificial Sequence
  Synthetic
uaguaagaauagacauuaaauagu

SEQ ID NO: 17694 - RNA, 18 nt, Artificial Sequence
  Synthetic
cugaggagaaggcaaggu

SEQ ID NO: 17695 - RNA, 19 nt, Artificial Sequence
  Synthetic
ccugaggagaaggcaaggu

SEQ ID NO: 17696 - RNA, 21 nt, Artificial Sequence
  Synthetic
uaccugaggagaaggcaaggu

SEQ ID NO: 17697 - RNA, 22 nt, Artificial Sequence
  Synthetic
uuaccugaggagaaggcaaggu

SEQ ID NO: 17698 - RNA, 23 nt, Artificial Sequence
  Synthetic
guuaccugaggagaaggcaaggu

SEQ ID NO: 17699 - RNA, 24 nt, Artificial Sequence
  Synthetic
aguuaccugaggagaaggcaaggu

SEQ ID NO: 17700 - RNA, 18 nt, Artificial Sequence
  Synthetic
gggcagaucacuugaggu

SEQ ID NO: 17701 - RNA, 19 nt, Artificial Sequence
  Synthetic
cgggcagaucacuugaggu

SEQ ID NO: 17702 - RNA, 20 nt, Artificial Sequence
  Synthetic
gcgggcagaucacuugaggu

SEQ ID NO: 17703 - RNA, 21 nt, Artificial Sequence
  Synthetic
ggcgggcagaucacuugaggu

SEQ ID NO: 17704 - RNA, 22 nt, Artificial Sequence
  Synthetic
aggcgggcagaucacuugaggu

SEQ ID NO: 17705 - RNA, 23 nt, Artificial Sequence
  Synthetic
aaggcgggcagaucacuugaggu

SEQ ID NO: 17706 - RNA, 24 nt, Artificial Sequence
  Synthetic
caaggcgggcagaucacuugaggu

SEQ ID NO: 17707 - RNA, 19 nt, Artificial Sequence
  Synthetic
ugggcagaucacuugaggu

SEQ ID NO: 17708 - RNA, 20 nt, Artificial Sequence
  Synthetic
gugggcagaucacuugaggu

SEQ ID NO: 17709 - RNA, 21 nt, Artificial Sequence
  Synthetic
ggugggcagaucacuugaggu

SEQ ID NO: 17710 - RNA, 22 nt, Artificial Sequence
  Synthetic
aggugggcagaucacuugaggu

SEQ ID NO: 17711 - RNA, 23 nt, Artificial Sequence
  Synthetic
aaggugggcagaucacuugaggu

SEQ ID NO: 17712 - RNA, 24 nt, Artificial Sequence
  Synthetic
caaggugggcagaucacuugaggu

SEQ ID NO: 17713 - RNA, 18 nt, Artificial Sequence
  Synthetic
guagaaagcugguccggu

SEQ ID NO: 17714 - RNA, 19 nt, Artificial Sequence
  Synthetic
uguagaaagcugguccggu

SEQ ID NO: 17715 - RNA, 20 nt, Artificial Sequence
  Synthetic
auguagaaagcugguccggu

SEQ ID NO: 17716 - RNA, 21 nt, Artificial Sequence
  Synthetic
uauguagaaagcugguccggu

SEQ ID NO: 17717 - RNA, 22 nt, Artificial Sequence
  Synthetic
uuauguagaaagcugguccggu

SEQ ID NO: 17718 - RNA, 23 nt, Artificial Sequence
  Synthetic
uuuauguagaaagcugguccggu

SEQ ID NO: 17719 - RNA, 24 nt, Artificial Sequence
  Synthetic
cuuuauguagaaagcugguccggu

SEQ ID NO: 17720 - RNA, 18 nt, Artificial Sequence
  Synthetic
accuauaaucccagcauu

SEQ ID NO: 17721 - RNA, 19 nt, Artificial Sequence
  Synthetic
caccuauaaucccagcauu

SEQ ID NO: 17722 - RNA, 20 nt, Artificial Sequence
  Synthetic
acaccuauaaucccagcauu

SEQ ID NO: 17723 - RNA, 21 nt, Artificial Sequence
  Synthetic
cacaccuauaaucccagcauu

SEQ ID NO: 17724 - RNA, 22 nt, Artificial Sequence
  Synthetic
ucacaccuauaaucccagcauu

SEQ ID NO: 17725 - RNA, 23 nt, Artificial Sequence
  Synthetic
cucacaccuauaaucccagcauu

SEQ ID NO: 17726 - RNA, 24 nt, Artificial Sequence
  Synthetic
gcucacaccuauaaucccagcauu

SEQ ID NO: 17727 - RNA, 18 nt, Artificial Sequence
  Synthetic
aauacccauuauauuauu

SEQ ID NO: 17728 - RNA, 19 nt, Artificial Sequence
  Synthetic
caauacccauuauauuauu

SEQ ID NO: 17729 - RNA, 20 nt, Artificial Sequence
  Synthetic
ucaauacccauuauauuauu

SEQ ID NO: 17730 - RNA, 21 nt, Artificial Sequence
  Synthetic
uucaauacccauuauauuauu

SEQ ID NO: 17731 - RNA, 22 nt, Artificial Sequence
  Synthetic
auucaauacccauuauauuauu

SEQ ID NO: 17732 - RNA, 23 nt, Artificial Sequence
  Synthetic
uauucaauacccauuauauuauu

SEQ ID NO: 17733 - RNA, 24 nt, Artificial Sequence
  Synthetic
auauucaauacccauuauauuauu

SEQ ID NO: 17734 - RNA, 18 nt, Artificial Sequence
  Synthetic
ccacuaaucccaacacuu

SEQ ID NO: 17735 - RNA, 19 nt, Artificial Sequence
  Synthetic
gccacuaaucccaacacuu

SEQ ID NO: 17736 - RNA, 21 nt, Artificial Sequence
  Synthetic
acgccacuaaucccaacacuu

SEQ ID NO: 17737 - RNA, 22 nt, Artificial Sequence
  Synthetic
cacgccacuaaucccaacacuu

SEQ ID NO: 17738 - RNA, 23 nt, Artificial Sequence
  Synthetic
ucacgccacuaaucccaacacuu

SEQ ID NO: 17739 - RNA, 24 nt, Artificial Sequence
  Synthetic
cucacgccacuaaucccaacacuu

SEQ ID NO: 17740 - RNA, 18 nt, Artificial Sequence
  Synthetic
accaucuggcaaccacuu

SEQ ID NO: 17741 - RNA, 19 nt, Artificial Sequence
  Synthetic
aaccaucuggcaaccacuu

SEQ ID NO: 17742 - RNA, 20 nt, Artificial Sequence
  Synthetic
caaccaucuggcaaccacuu

SEQ ID NO: 17743 - RNA, 21 nt, Artificial Sequence
  Synthetic
ucaaccaucuggcaaccacuu

SEQ ID NO: 17744 - RNA, 22 nt, Artificial Sequence
  Synthetic
uucaaccaucuggcaaccacuu

SEQ ID NO: 17745 - RNA, 23 nt, Artificial Sequence
  Synthetic
cuucaaccaucuggcaaccacuu

SEQ ID NO: 17746 - RNA, 24 nt, Artificial Sequence
  Synthetic
ucuucaaccaucuggcaaccacuu

SEQ ID NO: 17747 - RNA, 18 nt, Artificial Sequence
  Synthetic
augguggaaaccauacuu

SEQ ID NO: 17748 - RNA, 19 nt, Artificial Sequence
  Synthetic
caugguggaaaccauacuu

SEQ ID NO: 17749 - RNA, 20 nt, Artificial Sequence
  Synthetic
acaugguggaaaccauacuu

SEQ ID NO: 17750 - RNA, 21 nt, Artificial Sequence
  Synthetic
aacaugguggaaaccauacuu

SEQ ID NO: 17751 - RNA, 22 nt, Artificial Sequence
  Synthetic
gaacaugguggaaaccauacuu

SEQ ID NO: 17752 - RNA, 23 nt, Artificial Sequence
  Synthetic
ggaacaugguggaaaccauacuu

SEQ ID NO: 17753 - RNA, 24 nt, Artificial Sequence
  Synthetic
aggaacaugguggaaaccauacuu

SEQ ID NO: 17754 - RNA, 18 nt, Artificial Sequence
  Synthetic
cauggucacaaggcaguu

SEQ ID NO: 17755 - RNA, 19 nt, Artificial Sequence
  Synthetic
ccauggucacaaggcaguu

SEQ ID NO: 17756 - RNA, 20 nt, Artificial Sequence
  Synthetic
gccauggucacaaggcaguu

SEQ ID NO: 17757 - RNA, 21 nt, Artificial Sequence
  Synthetic
ggccauggucacaaggcaguu

SEQ ID NO: 17758 - RNA, 22 nt, Artificial Sequence
  Synthetic
gggccauggucacaaggcaguu

SEQ ID NO: 17759 - RNA, 23 nt, Artificial Sequence
  Synthetic
agggccauggucacaaggcaguu

SEQ ID NO: 17760 - RNA, 24 nt, Artificial Sequence
  Synthetic
gagggccauggucacaaggcaguu

SEQ ID NO: 17761 - RNA, 18 nt, Artificial Sequence
  Synthetic
uauucaaauauaaagguu

SEQ ID NO: 17762 - RNA, 19 nt, Artificial Sequence
  Synthetic
guauucaaauauaaagguu

SEQ ID NO: 17763 - RNA, 20 nt, Artificial Sequence
  Synthetic
uguauucaaauauaaagguu

SEQ ID NO: 17764 - RNA, 21 nt, Artificial Sequence
  Synthetic
uuguauucaaauauaaagguu

SEQ ID NO: 17765 - RNA, 22 nt, Artificial Sequence
  Synthetic
uuuguauucaaauauaaagguu

SEQ ID NO: 17766 - RNA, 23 nt, Artificial Sequence
  Synthetic
auuuguauucaaauauaaagguu

SEQ ID NO: 17767 - RNA, 24 nt, Artificial Sequence
  Synthetic
cauuuguauucaaauauaaagguu

SEQ ID NO: 17768 - RNA, 18 nt, Artificial Sequence
  Synthetic
ccuauaaucccagcauuu

SEQ ID NO: 17769 - RNA, 19 nt, Artificial Sequence
  Synthetic
accuauaaucccagcauuu

SEQ ID NO: 17770 - RNA, 21 nt, Artificial Sequence
  Synthetic
acaccuauaaucccagcauuu

SEQ ID NO: 17771 - RNA, 22 nt, Artificial Sequence
  Synthetic
cacaccuauaaucccagcauuu

SEQ ID NO: 17772 - RNA, 23 nt, Artificial Sequence
  Synthetic
ucacaccuauaaucccagcauuu

SEQ ID NO: 17773 - RNA, 24 nt, Artificial Sequence
  Synthetic
cucacaccuauaaucccagcauuu

SEQ ID NO: 17774 - RNA, 18 nt, Artificial Sequence
  Synthetic
cacuaaucccaacacuuu

SEQ ID NO: 17775 - RNA, 19 nt, Artificial Sequence
  Synthetic
ccacuaaucccaacacuuu

SEQ ID NO: 17776 - RNA, 21 nt, Artificial Sequence
  Synthetic
cgccacuaaucccaacacuuu

SEQ ID NO: 17777 - RNA, 22 nt, Artificial Sequence
  Synthetic
acgccacuaaucccaacacuuu

SEQ ID NO: 17778 - RNA, 23 nt, Artificial Sequence
  Synthetic
cacgccacuaaucccaacacuuu

SEQ ID NO: 17779 - RNA, 24 nt, Artificial Sequence
  Synthetic
ucacgccacuaaucccaacacuuu

SEQ ID NO: 17780 - RNA, 18 nt, Artificial Sequence
  Synthetic
gaaacugagagauucuuu

SEQ ID NO: 17781 - RNA, 19 nt, Artificial Sequence
  Synthetic
ggaaacugagagauucuuu

SEQ ID NO: 17782 - RNA, 20 nt, Artificial Sequence
  Synthetic
aggaaacugagagauucuuu

SEQ ID NO: 17783 - RNA, 21 nt, Artificial Sequence
  Synthetic
aaggaaacugagagauucuuu

SEQ ID NO: 17784 - RNA, 22 nt, Artificial Sequence
  Synthetic
aaaggaaacugagagauucuuu

SEQ ID NO: 17785 - RNA, 23 nt, Artificial Sequence
  Synthetic
gaaaggaaacugagagauucuuu

SEQ ID NO: 17786 - RNA, 24 nt, Artificial Sequence
  Synthetic
ggaaaggaaacugagagauucuuu

SEQ ID NO: 17787 - RNA, 18 nt, Artificial Sequence
  Synthetic
cccugggcaauguaguuu

SEQ ID NO: 17788 - RNA, 19 nt, Artificial Sequence
  Synthetic
acccugggcaauguaguuu

SEQ ID NO: 17789 - RNA, 20 nt, Artificial Sequence
  Synthetic
gacccugggcaauguaguuu

SEQ ID NO: 17790 - RNA, 21 nt, Artificial Sequence
  Synthetic
ugacccugggcaauguaguuu

SEQ ID NO: 17791 - RNA, 22 nt, Artificial Sequence
  Synthetic
gugacccugggcaauguaguuu

SEQ ID NO: 17792 - RNA, 23 nt, Artificial Sequence
  Synthetic
agugacccugggcaauguaguuu

SEQ ID NO: 17793 - RNA, 24 nt, Artificial Sequence
  Synthetic
uagugacccugggcaauguaguuu

SEQ ID NO: 17794 - RNA, 18 nt, Artificial Sequence
  Synthetic
cuauaaucccagcauuuu

SEQ ID NO: 17795 - RNA, 19 nt, Artificial Sequence
  Synthetic
ccuauaaucccagcauuuu

SEQ ID NO: 17796 - RNA, 21 nt, Artificial Sequence
  Synthetic
caccuauaaucccagcauuuu

SEQ ID NO: 17797 - RNA, 22 nt, Artificial Sequence
  Synthetic
acaccuauaaucccagcauuuu

SEQ ID NO: 17798 - RNA, 23 nt, Artificial Sequence
  Synthetic
cacaccuauaaucccagcauuuu

SEQ ID NO: 17799 - RNA, 24 nt, Artificial Sequence
  Synthetic
ucacaccuauaaucccagcauuuu

SEQ ID NO: 17800 - RNA, 18 nt, Artificial Sequence
  Synthetic
ccugggcaauguaguuuu

SEQ ID NO: 17801 - RNA, 19 nt, Artificial Sequence
  Synthetic
cccugggcaauguaguuuu

SEQ ID NO: 17802 - RNA, 21 nt, Artificial Sequence
  Synthetic
gacccugggcaauguaguuuu

SEQ ID NO: 17803 - RNA, 22 nt, Artificial Sequence
  Synthetic
ugacccugggcaauguaguuuu

SEQ ID NO: 17804 - RNA, 23 nt, Artificial Sequence
  Synthetic
gugacccugggcaauguaguuuu

SEQ ID NO: 17805 - RNA, 24 nt, Artificial Sequence
  Synthetic
agugacccugggcaauguaguuuu

SEQ ID NO: 17806 - RNA, 18 nt, Artificial Sequence
  Synthetic
aaccaaauguguauuuuu

SEQ ID NO: 17807 - RNA, 19 nt, Artificial Sequence
  Synthetic
aaaccaaauguguauuuuu

SEQ ID NO: 17808 - RNA, 20 nt, Artificial Sequence
  Synthetic
gaaaccaaauguguauuuuu

SEQ ID NO: 17809 - RNA, 21 nt, Artificial Sequence
  Synthetic
ugaaaccaaauguguauuuuu

SEQ ID NO: 17810 - RNA, 22 nt, Artificial Sequence
  Synthetic
cugaaaccaaauguguauuuuu

SEQ ID NO: 17811 - RNA, 23 nt, Artificial Sequence
  Synthetic
ucugaaaccaaauguguauuuuu

SEQ ID NO: 17812 - RNA, 24 nt, Artificial Sequence
  Synthetic
cucugaaaccaaauguguauuuuu

SEQ ID NO: 17813 - RNA, 18 nt, Artificial Sequence
  Synthetic
auaguauuuaaaagaaaa

SEQ ID NO: 17814 - RNA, 19 nt, Artificial Sequence
  Synthetic
uauaguauuuaaaagaaaa

SEQ ID NO: 17815 - RNA, 20 nt, Artificial Sequence
  Synthetic
cuauaguauuuaaaagaaaa

SEQ ID NO: 17816 - RNA, 21 nt, Artificial Sequence
  Synthetic
ccuauaguauuuaaaagaaaa

SEQ ID NO: 17817 - RNA, 22 nt, Artificial Sequence
  Synthetic
uccuauaguauuuaaaagaaaa

SEQ ID NO: 17818 - RNA, 23 nt, Artificial Sequence
  Synthetic
uuccuauaguauuuaaaagaaaa

SEQ ID NO: 17819 - RNA, 24 nt, Artificial Sequence
  Synthetic
guuccuauaguauuuaaaagaaaa

SEQ ID NO: 17820 - RNA, 18 nt, Artificial Sequence
  Synthetic
auuuuacagaaaagcaaa

SEQ ID NO: 17821 - RNA, 19 nt, Artificial Sequence
  Synthetic
uauuuuacagaaaagcaaa

SEQ ID NO: 17822 - RNA, 20 nt, Artificial Sequence
  Synthetic
cuauuuuacagaaaagcaaa

SEQ ID NO: 17823 - RNA, 21 nt, Artificial Sequence
  Synthetic
ucuauuuuacagaaaagcaaa

SEQ ID NO: 17824 - RNA, 22 nt, Artificial Sequence
  Synthetic
cucuauuuuacagaaaagcaaa

SEQ ID NO: 17825 - RNA, 23 nt, Artificial Sequence
  Synthetic
ucucuauuuuacagaaaagcaaa

SEQ ID NO: 17826 - RNA, 24 nt, Artificial Sequence
  Synthetic
aucucuauuuuacagaaaagcaaa

SEQ ID NO: 17827 - RNA, 18 nt, Artificial Sequence
  Synthetic
ugauuuuaguaguugaaa

SEQ ID NO: 17828 - RNA, 19 nt, Artificial Sequence
  Synthetic
augauuuuaguaguugaaa

SEQ ID NO: 17829 - RNA, 20 nt, Artificial Sequence
  Synthetic
caugauuuuaguaguugaaa

SEQ ID NO: 17830 - RNA, 21 nt, Artificial Sequence
  Synthetic
acaugauuuuaguaguugaaa

SEQ ID NO: 17831 - RNA, 22 nt, Artificial Sequence
  Synthetic
uacaugauuuuaguaguugaaa

SEQ ID NO: 17832 - RNA, 23 nt, Artificial Sequence
  Synthetic
auacaugauuuuaguaguugaaa

SEQ ID NO: 17833 - RNA, 24 nt, Artificial Sequence
  Synthetic
aauacaugauuuuaguaguugaaa

SEQ ID NO: 17834 - RNA, 18 nt, Artificial Sequence
  Synthetic
cuagcuuaaguaaauaaa

SEQ ID NO: 17835 - RNA, 19 nt, Artificial Sequence
  Synthetic
acuagcuuaaguaaauaaa

SEQ ID NO: 17836 - RNA, 21 nt, Artificial Sequence
  Synthetic
uuacuagcuuaaguaaauaaa

SEQ ID NO: 17837 - RNA, 22 nt, Artificial Sequence
  Synthetic
uuuacuagcuuaaguaaauaaa

SEQ ID NO: 17838 - RNA, 23 nt, Artificial Sequence
  Synthetic
auuuacuagcuuaaguaaauaaa

SEQ ID NO: 17839 - RNA, 24 nt, Artificial Sequence
  Synthetic
aauuuacuagcuuaaguaaauaaa

SEQ ID NO: 17840 - RNA, 18 nt, Artificial Sequence
  Synthetic
cuggccuuaggaacucaa

SEQ ID NO: 17841 - RNA, 19 nt, Artificial Sequence
  Synthetic
acuggccuuaggaacucaa

SEQ ID NO: 17842 - RNA, 21 nt, Artificial Sequence
  Synthetic
gaacuggccuuaggaacucaa

SEQ ID NO: 17843 - RNA, 22 nt, Artificial Sequence
  Synthetic
agaacuggccuuaggaacucaa

SEQ ID NO: 17844 - RNA, 23 nt, Artificial Sequence
  Synthetic
gagaacuggccuuaggaacucaa

SEQ ID NO: 17845 - RNA, 24 nt, Artificial Sequence
  Synthetic
ggagaacuggccuuaggaacucaa

SEQ ID NO: 17846 - RNA, 18 nt, Artificial Sequence
  Synthetic
auccccaagugccuagaa

SEQ ID NO: 17847 - RNA, 19 nt, Artificial Sequence
  Synthetic
uauccccaagugccuagaa

SEQ ID NO: 17848 - RNA, 20 nt, Artificial Sequence
  Synthetic
guauccccaagugccuagaa

SEQ ID NO: 17849 - RNA, 21 nt, Artificial Sequence
  Synthetic
uguauccccaagugccuagaa

SEQ ID NO: 17850 - RNA, 22 nt, Artificial Sequence
  Synthetic
auguauccccaagugccuagaa

SEQ ID NO: 17851 - RNA, 23 nt, Artificial Sequence
  Synthetic
gauguauccccaagugccuagaa

SEQ ID NO: 17852 - RNA, 24 nt, Artificial Sequence
  Synthetic
ugauguauccccaagugccuagaa

SEQ ID NO: 17853 - RNA, 18 nt, Artificial Sequence
  Synthetic
gauaaaagggugagugaa

SEQ ID NO: 17854 - RNA, 19 nt, Artificial Sequence
  Synthetic
agauaaaagggugagugaa

SEQ ID NO: 17855 - RNA, 21 nt, Artificial Sequence
  Synthetic
ccagauaaaagggugagugaa

SEQ ID NO: 17856 - RNA, 22 nt, Artificial Sequence
  Synthetic
gccagauaaaagggugagugaa

SEQ ID NO: 17857 - RNA, 23 nt, Artificial Sequence
  Synthetic
ugccagauaaaagggugagugaa

SEQ ID NO: 17858 - RNA, 24 nt, Artificial Sequence
  Synthetic
augccagauaaaagggugagugaa

SEQ ID NO: 17859 - RNA, 18 nt, Artificial Sequence
  Synthetic
auuuuauuccuuugugaa

SEQ ID NO: 17860 - RNA, 19 nt, Artificial Sequence
  Synthetic
uauuuuauuccuuugugaa

SEQ ID NO: 17861 - RNA, 20 nt, Artificial Sequence
  Synthetic
auauuuuauuccuuugugaa

SEQ ID NO: 17862 - RNA, 21 nt, Artificial Sequence
  Synthetic
gauauuuuauuccuuugugaa

SEQ ID NO: 17863 - RNA, 22 nt, Artificial Sequence
  Synthetic
agauauuuuauuccuuugugaa

SEQ ID NO: 17864 - RNA, 23 nt, Artificial Sequence
  Synthetic
gagauauuuuauuccuuugugaa

SEQ ID NO: 17865 - RNA, 24 nt, Artificial Sequence
  Synthetic
agagauauuuuauuccuuugugaa

SEQ ID NO: 17866 - RNA, 18 nt, Artificial Sequence
  Synthetic
acuagcuuaaguaaauaa

SEQ ID NO: 17867 - RNA, 19 nt, Artificial Sequence
  Synthetic
uacuagcuuaaguaaauaa

SEQ ID NO: 17868 - RNA, 20 nt, Artificial Sequence
  Synthetic
uuacuagcuuaaguaaauaa

SEQ ID NO: 17869 - RNA, 21 nt, Artificial Sequence
  Synthetic
uuuacuagcuuaaguaaauaa

SEQ ID NO: 17870 - RNA, 22 nt, Artificial Sequence
  Synthetic
auuuacuagcuuaaguaaauaa

SEQ ID NO: 17871 - RNA, 23 nt, Artificial Sequence
  Synthetic
aauuuacuagcuuaaguaaauaa

SEQ ID NO: 17872 - RNA, 24 nt, Artificial Sequence
  Synthetic
caauuuacuagcuuaaguaaauaa

SEQ ID NO: 17873 - RNA, 18 nt, Artificial Sequence
  Synthetic
ugucuauucuuacuauaa

SEQ ID NO: 17874 - RNA, 19 nt, Artificial Sequence
  Synthetic
augucuauucuuacuauaa

SEQ ID NO: 17875 - RNA, 20 nt, Artificial Sequence
  Synthetic
aaugucuauucuuacuauaa

SEQ ID NO: 17876 - RNA, 21 nt, Artificial Sequence
  Synthetic
uaaugucuauucuuacuauaa

SEQ ID NO: 17877 - RNA, 22 nt, Artificial Sequence
  Synthetic
uuaaugucuauucuuacuauaa

SEQ ID NO: 17878 - RNA, 23 nt, Artificial Sequence
  Synthetic
uuuaaugucuauucuuacuauaa

SEQ ID NO: 17879 - RNA, 24 nt, Artificial Sequence
  Synthetic
auuuaaugucuauucuuacuauaa

SEQ ID NO: 17880 - RNA, 18 nt, Artificial Sequence
  Synthetic
augguaacuugacaguaa

SEQ ID NO: 17881 - RNA, 19 nt, Artificial Sequence
  Synthetic
uaugguaacuugacaguaa

SEQ ID NO: 17882 - RNA, 21 nt, Artificial Sequence
  Synthetic
cuuaugguaacuugacaguaa

SEQ ID NO: 17883 - RNA, 22 nt, Artificial Sequence
  Synthetic
acuuaugguaacuugacaguaa

SEQ ID NO: 17884 - RNA, 23 nt, Artificial Sequence
  Synthetic
uacuuaugguaacuugacaguaa

SEQ ID NO: 17885 - RNA, 24 nt, Artificial Sequence
  Synthetic
uuacuuaugguaacuugacaguaa

SEQ ID NO: 17886 - RNA, 18 nt, Artificial Sequence
  Synthetic
aaaaaaggcuuucauuaa

SEQ ID NO: 17887 - RNA, 19 nt, Artificial Sequence
  Synthetic
gaaaaaaggcuuucauuaa

SEQ ID NO: 17888 - RNA, 20 nt, Artificial Sequence
  Synthetic
agaaaaaaggcuuucauuaa

SEQ ID NO: 17889 - RNA, 21 nt, Artificial Sequence
  Synthetic
gagaaaaaaggcuuucauuaa

SEQ ID NO: 17890 - RNA, 22 nt, Artificial Sequence
  Synthetic
agagaaaaaaggcuuucauuaa

SEQ ID NO: 17891 - RNA, 23 nt, Artificial Sequence
  Synthetic
aagagaaaaaaggcuuucauuaa

SEQ ID NO: 17892 - RNA, 24 nt, Artificial Sequence
  Synthetic
gaagagaaaaaaggcuuucauuaa

SEQ ID NO: 17893 - RNA, 18 nt, Artificial Sequence
  Synthetic
agaguagggcuggguuaa

SEQ ID NO: 17894 - RNA, 19 nt, Artificial Sequence
  Synthetic
cagaguagggcuggguuaa

SEQ ID NO: 17895 - RNA, 20 nt, Artificial Sequence
  Synthetic
ucagaguagggcuggguuaa

SEQ ID NO: 17896 - RNA, 21 nt, Artificial Sequence
  Synthetic
aucagaguagggcuggguuaa

SEQ ID NO: 17897 - RNA, 22 nt, Artificial Sequence
  Synthetic
aaucagaguagggcuggguuaa

SEQ ID NO: 17898 - RNA, 23 nt, Artificial Sequence
  Synthetic
uaaucagaguagggcuggguuaa

SEQ ID NO: 17899 - RNA, 24 nt, Artificial Sequence
  Synthetic
uuaaucagaguagggcuggguuaa

SEQ ID NO: 17900 - RNA, 18 nt, Artificial Sequence
  Synthetic
uguuccuauaguauuuaa

SEQ ID NO: 17901 - RNA, 19 nt, Artificial Sequence
  Synthetic
guguuccuauaguauuuaa

SEQ ID NO: 17902 - RNA, 20 nt, Artificial Sequence
  Synthetic
gguguuccuauaguauuuaa

SEQ ID NO: 17903 - RNA, 21 nt, Artificial Sequence
  Synthetic
ugguguuccuauaguauuuaa

SEQ ID NO: 17904 - RNA, 22 nt, Artificial Sequence
  Synthetic
cugguguuccuauaguauuuaa

SEQ ID NO: 17905 - RNA, 23 nt, Artificial Sequence
  Synthetic
gcugguguuccuauaguauuuaa

SEQ ID NO: 17906 - RNA, 24 nt, Artificial Sequence
  Synthetic
agcugguguuccuauaguauuuaa

SEQ ID NO: 17907 - RNA, 18 nt, Artificial Sequence
  Synthetic
guggaccacuuuuucaca

SEQ ID NO: 17908 - RNA, 19 nt, Artificial Sequence
  Synthetic
uguggaccacuuuuucaca

SEQ ID NO: 17909 - RNA, 20 nt, Artificial Sequence
  Synthetic
guguggaccacuuuuucaca

SEQ ID NO: 17910 - RNA, 21 nt, Artificial Sequence
  Synthetic
cguguggaccacuuuuucaca

SEQ ID NO: 17911 - RNA, 22 nt, Artificial Sequence
  Synthetic
ccguguggaccacuuuuucaca

SEQ ID NO: 17912 - RNA, 23 nt, Artificial Sequence
  Synthetic
uccguguggaccacuuuuucaca

SEQ ID NO: 17913 - RNA, 24 nt, Artificial Sequence
  Synthetic
uuccguguggaccacuuuuucaca

SEQ ID NO: 17914 - RNA, 18 nt, Artificial Sequence
  Synthetic
gaaauggcuagcauuaca

SEQ ID NO: 17915 - RNA, 19 nt, Artificial Sequence
  Synthetic
ugaaauggcuagcauuaca

SEQ ID NO: 17916 - RNA, 20 nt, Artificial Sequence
  Synthetic
gugaaauggcuagcauuaca

SEQ ID NO: 17917 - RNA, 21 nt, Artificial Sequence
  Synthetic
ugugaaauggcuagcauuaca

SEQ ID NO: 17918 - RNA, 22 nt, Artificial Sequence
  Synthetic
augugaaauggcuagcauuaca

SEQ ID NO: 17919 - RNA, 23 nt, Artificial Sequence
  Synthetic
aaugugaaauggcuagcauuaca

SEQ ID NO: 17920 - RNA, 24 nt, Artificial Sequence
  Synthetic
gaaugugaaauggcuagcauuaca

SEQ ID NO: 17921 - RNA, 18 nt, Artificial Sequence
  Synthetic
acuggccuuaggaacuca

SEQ ID NO: 17922 - RNA, 19 nt, Artificial Sequence
  Synthetic
aacuggccuuaggaacuca

SEQ ID NO: 17923 - RNA, 20 nt, Artificial Sequence
  Synthetic
gaacuggccuuaggaacuca

SEQ ID NO: 17924 - RNA, 21 nt, Artificial Sequence
  Synthetic
agaacuggccuuaggaacuca

SEQ ID NO: 17925 - RNA, 22 nt, Artificial Sequence
  Synthetic
gagaacuggccuuaggaacuca

SEQ ID NO: 17926 - RNA, 23 nt, Artificial Sequence
  Synthetic
ggagaacuggccuuaggaacuca

SEQ ID NO: 17927 - RNA, 24 nt, Artificial Sequence
  Synthetic
uggagaacuggccuuaggaacuca

SEQ ID NO: 17928 - RNA, 18 nt, Artificial Sequence
  Synthetic
aaagcaaacugaggcuca

SEQ ID NO: 17929 - RNA, 19 nt, Artificial Sequence
  Synthetic
aaaagcaaacugaggcuca

SEQ ID NO: 17930 - RNA, 20 nt, Artificial Sequence
  Synthetic
gaaaagcaaacugaggcuca

SEQ ID NO: 17931 - RNA, 21 nt, Artificial Sequence
  Synthetic
agaaaagcaaacugaggcuca

SEQ ID NO: 17932 - RNA, 22 nt, Artificial Sequence
  Synthetic
cagaaaagcaaacugaggcuca

SEQ ID NO: 17933 - RNA, 23 nt, Artificial Sequence
  Synthetic
acagaaaagcaaacugaggcuca

SEQ ID NO: 17934 - RNA, 24 nt, Artificial Sequence
  Synthetic
uacagaaaagcaaacugaggcuca

SEQ ID NO: 17935 - RNA, 18 nt, Artificial Sequence
  Synthetic
uuuaaggaccacgaaaga

SEQ ID NO: 17936 - RNA, 19 nt, Artificial Sequence
  Synthetic
cuuuaaggaccacgaaaga

SEQ ID NO: 17937 - RNA, 21 nt, Artificial Sequence
  Synthetic
aucuuuaaggaccacgaaaga

SEQ ID NO: 17938 - RNA, 22 nt, Artificial Sequence
  Synthetic
uaucuuuaaggaccacgaaaga

SEQ ID NO: 17939 - RNA, 23 nt, Artificial Sequence
  Synthetic
cuaucuuuaaggaccacgaaaga

SEQ ID NO: 17940 - RNA, 24 nt, Artificial Sequence
  Synthetic
ccuaucuuuaaggaccacgaaaga

SEQ ID NO: 17941 - RNA, 18 nt, Artificial Sequence
  Synthetic
uuuguauuuauggccaga

SEQ ID NO: 17942 - RNA, 19 nt, Artificial Sequence
  Synthetic
auuuguauuuauggccaga

SEQ ID NO: 17943 - RNA, 20 nt, Artificial Sequence
  Synthetic
cauuuguauuuauggccaga

SEQ ID NO: 17944 - RNA, 21 nt, Artificial Sequence
  Synthetic
acauuuguauuuauggccaga

SEQ ID NO: 17945 - RNA, 22 nt, Artificial Sequence
  Synthetic
uacauuuguauuuauggccaga

SEQ ID NO: 17946 - RNA, 23 nt, Artificial Sequence
  Synthetic
auacauuuguauuuauggccaga

SEQ ID NO: 17947 - RNA, 24 nt, Artificial Sequence
  Synthetic
gauacauuuguauuuauggccaga

SEQ ID NO: 17948 - RNA, 18 nt, Artificial Sequence
  Synthetic
ugguuuuauuuucucaga

SEQ ID NO: 17949 - RNA, 19 nt, Artificial Sequence
  Synthetic
cugguuuuauuuucucaga

SEQ ID NO: 17950 - RNA, 20 nt, Artificial Sequence
  Synthetic
gcugguuuuauuuucucaga

SEQ ID NO: 17951 - RNA, 21 nt, Artificial Sequence
  Synthetic
ugcugguuuuauuuucucaga

SEQ ID NO: 17952 - RNA, 22 nt, Artificial Sequence
  Synthetic
augcugguuuuauuuucucaga

SEQ ID NO: 17953 - RNA, 23 nt, Artificial Sequence
  Synthetic
uaugcugguuuuauuuucucaga

SEQ ID NO: 17954 - RNA, 24 nt, Artificial Sequence
  Synthetic
uuaugcugguuuuauuuucucaga

SEQ ID NO: 17955 - RNA, 18 nt, Artificial Sequence
  Synthetic
uguggggagggaaauaga

SEQ ID NO: 17956 - RNA, 19 nt, Artificial Sequence
  Synthetic
auguggggagggaaauaga

SEQ ID NO: 17957 - RNA, 21 nt, Artificial Sequence
  Synthetic
gcauguggggagggaaauaga

SEQ ID NO: 17958 - RNA, 22 nt, Artificial Sequence
  Synthetic
agcauguggggagggaaauaga

SEQ ID NO: 17959 - RNA, 23 nt, Artificial Sequence
  Synthetic
aagcauguggggagggaaauaga

SEQ ID NO: 17960 - RNA, 24 nt, Artificial Sequence
  Synthetic
gaagcauguggggagggaaauaga

SEQ ID NO: 17961 - RNA, 18 nt, Artificial Sequence
  Synthetic
ggccacucauagucuaga

SEQ ID NO: 17962 - RNA, 19 nt, Artificial Sequence
  Synthetic
gggccacucauagucuaga

SEQ ID NO: 17963 - RNA, 20 nt, Artificial Sequence
  Synthetic
ugggccacucauagucuaga

SEQ ID NO: 17964 - RNA, 21 nt, Artificial Sequence
  Synthetic
uugggccacucauagucuaga

SEQ ID NO: 17965 - RNA, 22 nt, Artificial Sequence
  Synthetic
cuugggccacucauagucuaga

SEQ ID NO: 17966 - RNA, 23 nt, Artificial Sequence
  Synthetic
ccuugggccacucauagucuaga

SEQ ID NO: 17967 - RNA, 24 nt, Artificial Sequence
  Synthetic
cccuugggccacucauagucuaga

SEQ ID NO: 17968 - RNA, 18 nt, Artificial Sequence
  Synthetic
uaucuuuaaggaccacga

SEQ ID NO: 17969 - RNA, 19 nt, Artificial Sequence
  Synthetic
cuaucuuuaaggaccacga

SEQ ID NO: 17970 - RNA, 20 nt, Artificial Sequence
  Synthetic
ccuaucuuuaaggaccacga

SEQ ID NO: 17971 - RNA, 21 nt, Artificial Sequence
  Synthetic
uccuaucuuuaaggaccacga

SEQ ID NO: 17972 - RNA, 22 nt, Artificial Sequence
  Synthetic
cuccuaucuuuaaggaccacga

SEQ ID NO: 17973 - RNA, 23 nt, Artificial Sequence
  Synthetic
gcuccuaucuuuaaggaccacga

SEQ ID NO: 17974 - RNA, 24 nt, Artificial Sequence
  Synthetic
ugcuccuaucuuuaaggaccacga

SEQ ID NO: 17975 - RNA, 18 nt, Artificial Sequence
  Synthetic
uggagaagcaugugggga

SEQ ID NO: 17976 - RNA, 19 nt, Artificial Sequence
  Synthetic
guggagaagcaugugggga

SEQ ID NO: 17977 - RNA, 21 nt, Artificial Sequence
  Synthetic
agguggagaagcaugugggga

SEQ ID NO: 17978 - RNA, 22 nt, Artificial Sequence
  Synthetic
aagguggagaagcaugugggga

SEQ ID NO: 17979 - RNA, 23 nt, Artificial Sequence
  Synthetic
aaagguggagaagcaugugggga

SEQ ID NO: 17980 - RNA, 24 nt, Artificial Sequence
  Synthetic
gaaagguggagaagcaugugggga

SEQ ID NO: 17981 - RNA, 18 nt, Artificial Sequence
  Synthetic
guaaccaaauguuaugga

SEQ ID NO: 17982 - RNA, 19 nt, Artificial Sequence
  Synthetic
aguaaccaaauguuaugga

SEQ ID NO: 17983 - RNA, 21 nt, Artificial Sequence
  Synthetic
ugaguaaccaaauguuaugga

SEQ ID NO: 17984 - RNA, 22 nt, Artificial Sequence
  Synthetic
cugaguaaccaaauguuaugga

SEQ ID NO: 17985 - RNA, 23 nt, Artificial Sequence
  Synthetic
ucugaguaaccaaauguuaugga

SEQ ID NO: 17986 - RNA, 24 nt, Artificial Sequence
  Synthetic
cucugaguaaccaaauguuaugga

SEQ ID NO: 17987 - RNA, 18 nt, Artificial Sequence
  Synthetic
uugccaguuaaugaauga

SEQ ID NO: 17988 - RNA, 19 nt, Artificial Sequence
  Synthetic
uuugccaguuaaugaauga

SEQ ID NO: 17989 - RNA, 21 nt, Artificial Sequence
  Synthetic
acuuugccaguuaaugaauga

SEQ ID NO: 17990 - RNA, 22 nt, Artificial Sequence
  Synthetic
uacuuugccaguuaaugaauga

SEQ ID NO: 17991 - RNA, 23 nt, Artificial Sequence
  Synthetic
auacuuugccaguuaaugaauga

SEQ ID NO: 17992 - RNA, 24 nt, Artificial Sequence
  Synthetic
uauacuuugccaguuaaugaauga

SEQ ID NO: 17993 - RNA, 18 nt, Artificial Sequence
  Synthetic
uccucucagccacucuga

SEQ ID NO: 17994 - RNA, 19 nt, Artificial Sequence
  Synthetic
cuccucucagccacucuga

SEQ ID NO: 17995 - RNA, 20 nt, Artificial Sequence
  Synthetic
ucuccucucagccacucuga

SEQ ID NO: 17996 - RNA, 21 nt, Artificial Sequence
  Synthetic
aucuccucucagccacucuga

SEQ ID NO: 17997 - RNA, 22 nt, Artificial Sequence
  Synthetic
uaucuccucucagccacucuga

SEQ ID NO: 17998 - RNA, 23 nt, Artificial Sequence
  Synthetic
auaucuccucucagccacucuga

SEQ ID NO: 17999 - RNA, 24 nt, Artificial Sequence
  Synthetic
aauaucuccucucagccacucuga

SEQ ID NO: 18000 - RNA, 18 nt, Artificial Sequence
  Synthetic
ccuuuugauugccaguga

SEQ ID NO: 18001 - RNA, 19 nt, Artificial Sequence
  Synthetic
uccuuuugauugccaguga

SEQ ID NO: 18002 - RNA, 20 nt, Artificial Sequence
  Synthetic
auccuuuugauugccaguga

SEQ ID NO: 18003 - RNA, 21 nt, Artificial Sequence
  Synthetic
gauccuuuugauugccaguga

SEQ ID NO: 18004 - RNA, 22 nt, Artificial Sequence
  Synthetic
ggauccuuuugauugccaguga

SEQ ID NO: 18005 - RNA, 23 nt, Artificial Sequence
  Synthetic
aggauccuuuugauugccaguga

SEQ ID NO: 18006 - RNA, 24 nt, Artificial Sequence
  Synthetic
uaggauccuuuugauugccaguga

SEQ ID NO: 18007 - RNA, 18 nt, Artificial Sequence
  Synthetic
agauaaaagggugaguga

SEQ ID NO: 18008 - RNA, 19 nt, Artificial Sequence
  Synthetic
cagauaaaagggugaguga

SEQ ID NO: 18009 - RNA, 21 nt, Artificial Sequence
  Synthetic
gccagauaaaagggugaguga

SEQ ID NO: 18010 - RNA, 22 nt, Artificial Sequence
  Synthetic
ugccagauaaaagggugaguga

SEQ ID NO: 18011 - RNA, 23 nt, Artificial Sequence
  Synthetic
augccagauaaaagggugaguga

SEQ ID NO: 18012 - RNA, 24 nt, Artificial Sequence
  Synthetic
gaugccagauaaaagggugaguga

SEQ ID NO: 18013 - RNA, 18 nt, Artificial Sequence
  Synthetic
ugccagauaaaaggguga

SEQ ID NO: 18014 - RNA, 19 nt, Artificial Sequence
  Synthetic
augccagauaaaaggguga

SEQ ID NO: 18015 - RNA, 20 nt, Artificial Sequence
  Synthetic
gaugccagauaaaaggguga

SEQ ID NO: 18016 - RNA, 21 nt, Artificial Sequence
  Synthetic
ugaugccagauaaaaggguga

SEQ ID NO: 18017 - RNA, 22 nt, Artificial Sequence
  Synthetic
cugaugccagauaaaaggguga

SEQ ID NO: 18018 - RNA, 23 nt, Artificial Sequence
  Synthetic
ccugaugccagauaaaaggguga

SEQ ID NO: 18019 - RNA, 24 nt, Artificial Sequence
  Synthetic
gccugaugccagauaaaaggguga

SEQ ID NO: 18020 - RNA, 18 nt, Artificial Sequence
  Synthetic
gguuagcucuguguguga

SEQ ID NO: 18021 - RNA, 19 nt, Artificial Sequence
  Synthetic
agguuagcucuguguguga

SEQ ID NO: 18022 - RNA, 20 nt, Artificial Sequence
  Synthetic
gagguuagcucuguguguga

SEQ ID NO: 18023 - RNA, 21 nt, Artificial Sequence
  Synthetic
ggagguuagcucuguguguga

SEQ ID NO: 18024 - RNA, 22 nt, Artificial Sequence
  Synthetic
gggagguuagcucuguguguga

SEQ ID NO: 18025 - RNA, 23 nt, Artificial Sequence
  Synthetic
ugggagguuagcucuguguguga

SEQ ID NO: 18026 - RNA, 24 nt, Artificial Sequence
  Synthetic
augggagguuagcucuguguguga

SEQ ID NO: 18027 - RNA, 18 nt, Artificial Sequence
  Synthetic
gauccauuucuccuuuga

SEQ ID NO: 18028 - RNA, 19 nt, Artificial Sequence
  Synthetic
ugauccauuucuccuuuga

SEQ ID NO: 18029 - RNA, 21 nt, Artificial Sequence
  Synthetic
ucugauccauuucuccuuuga

SEQ ID NO: 18030 - RNA, 22 nt, Artificial Sequence
  Synthetic
aucugauccauuucuccuuuga

SEQ ID NO: 18031 - RNA, 23 nt, Artificial Sequence
  Synthetic
caucugauccauuucuccuuuga

SEQ ID NO: 18032 - RNA, 24 nt, Artificial Sequence
  Synthetic
ccaucugauccauuucuccuuuga

SEQ ID NO: 18033 - RNA, 18 nt, Artificial Sequence
  Synthetic
uguauuuauggccagaua

SEQ ID NO: 18034 - RNA, 19 nt, Artificial Sequence
  Synthetic
uuguauuuauggccagaua

SEQ ID NO: 18035 - RNA, 20 nt, Artificial Sequence
  Synthetic
uuuguauuuauggccagaua

SEQ ID NO: 18036 - RNA, 21 nt, Artificial Sequence
  Synthetic
auuuguauuuauggccagaua

SEQ ID NO: 18037 - RNA, 22 nt, Artificial Sequence
  Synthetic
cauuuguauuuauggccagaua

SEQ ID NO: 18038 - RNA, 23 nt, Artificial Sequence
  Synthetic
acauuuguauuuauggccagaua

SEQ ID NO: 18039 - RNA, 24 nt, Artificial Sequence
  Synthetic
uacauuuguauuuauggccagaua

SEQ ID NO: 18040 - RNA, 18 nt, Artificial Sequence
  Synthetic
auucaaagaauuaagcua

SEQ ID NO: 18041 - RNA, 19 nt, Artificial Sequence
  Synthetic
uauucaaagaauuaagcua

SEQ ID NO: 18042 - RNA, 20 nt, Artificial Sequence
  Synthetic
uuauucaaagaauuaagcua

SEQ ID NO: 18043 - RNA, 21 nt, Artificial Sequence
  Synthetic
uuuauucaaagaauuaagcua

SEQ ID NO: 18044 - RNA, 22 nt, Artificial Sequence
  Synthetic
uuuuauucaaagaauuaagcua

SEQ ID NO: 18045 - RNA, 23 nt, Artificial Sequence
  Synthetic
auuuuauucaaagaauuaagcua

SEQ ID NO: 18046 - RNA, 24 nt, Artificial Sequence
  Synthetic
gauuuuauucaaagaauuaagcua

SEQ ID NO: 18047 - RNA, 18 nt, Artificial Sequence
  Synthetic
uaugguaacuugacagua

SEQ ID NO: 18048 - RNA, 19 nt, Artificial Sequence
  Synthetic
uuaugguaacuugacagua

SEQ ID NO: 18049 - RNA, 20 nt, Artificial Sequence
  Synthetic
cuuaugguaacuugacagua

SEQ ID NO: 18050 - RNA, 21 nt, Artificial Sequence
  Synthetic
acuuaugguaacuugacagua

SEQ ID NO: 18051 - RNA, 22 nt, Artificial Sequence
  Synthetic
uacuuaugguaacuugacagua

SEQ ID NO: 18052 - RNA, 23 nt, Artificial Sequence
  Synthetic
uuacuuaugguaacuugacagua

SEQ ID NO: 18053 - RNA, 24 nt, Artificial Sequence
  Synthetic
uuuacuuaugguaacuugacagua

SEQ ID NO: 18054 - RNA, 18 nt, Artificial Sequence
  Synthetic
uucaaguuucacccauua

SEQ ID NO: 18055 - RNA, 19 nt, Artificial Sequence
  Synthetic
guucaaguuucacccauua

SEQ ID NO: 18056 - RNA, 20 nt, Artificial Sequence
  Synthetic
uguucaaguuucacccauua

SEQ ID NO: 18057 - RNA, 21 nt, Artificial Sequence
  Synthetic
uuguucaaguuucacccauua

SEQ ID NO: 18058 - RNA, 22 nt, Artificial Sequence
  Synthetic
guuguucaaguuucacccauua

SEQ ID NO: 18059 - RNA, 23 nt, Artificial Sequence
  Synthetic
aguuguucaaguuucacccauua

SEQ ID NO: 18060 - RNA, 24 nt, Artificial Sequence
  Synthetic
aaguuguucaaguuucacccauua

SEQ ID NO: 18061 - RNA, 18 nt, Artificial Sequence
  Synthetic
aagggccagcuucuauua

SEQ ID NO: 18062 - RNA, 19 nt, Artificial Sequence
  Synthetic
caagggccagcuucuauua

SEQ ID NO: 18063 - RNA, 20 nt, Artificial Sequence
  Synthetic
ucaagggccagcuucuauua

SEQ ID NO: 18064 - RNA, 21 nt, Artificial Sequence
  Synthetic
aucaagggccagcuucuauua

SEQ ID NO: 18065 - RNA, 22 nt, Artificial Sequence
  Synthetic
gaucaagggccagcuucuauua

SEQ ID NO: 18066 - RNA, 23 nt, Artificial Sequence
  Synthetic
agaucaagggccagcuucuauua

SEQ ID NO: 18067 - RNA, 24 nt, Artificial Sequence
  Synthetic
aagaucaagggccagcuucuauua

SEQ ID NO: 18068 - RNA, 18 nt, Artificial Sequence
  Synthetic
auugguauuugaaauuua

SEQ ID NO: 18069 - RNA, 19 nt, Artificial Sequence
  Synthetic
aauugguauuugaaauuua

SEQ ID NO: 18070 - RNA, 20 nt, Artificial Sequence
  Synthetic
aaauugguauuugaaauuua

SEQ ID NO: 18071 - RNA, 21 nt, Artificial Sequence
  Synthetic
aaaauugguauuugaaauuua

SEQ ID NO: 18072 - RNA, 22 nt, Artificial Sequence
  Synthetic
uaaaauugguauuugaaauuua

SEQ ID NO: 18073 - RNA, 23 nt, Artificial Sequence
  Synthetic
auaaaauugguauuugaaauuua

SEQ ID NO: 18074 - RNA, 24 nt, Artificial Sequence
  Synthetic
uauaaaauugguauuugaaauuua

SEQ ID NO: 18075 - RNA, 18 nt, Artificial Sequence
  Synthetic
aaagguaauuaggcuuua

SEQ ID NO: 18076 - RNA, 19 nt, Artificial Sequence
  Synthetic
aaaagguaauuaggcuuua

SEQ ID NO: 18077 - RNA, 20 nt, Artificial Sequence
  Synthetic
gaaaagguaauuaggcuuua

SEQ ID NO: 18078 - RNA, 21 nt, Artificial Sequence
  Synthetic
ggaaaagguaauuaggcuuua

SEQ ID NO: 18079 - RNA, 22 nt, Artificial Sequence
  Synthetic
gggaaaagguaauuaggcuuua

SEQ ID NO: 18080 - RNA, 23 nt, Artificial Sequence
  Synthetic
ugggaaaagguaauuaggcuuua

SEQ ID NO: 18081 - RNA, 24 nt, Artificial Sequence
  Synthetic
augggaaaagguaauuaggcuuua

SEQ ID NO: 18082 - RNA, 18 nt, Artificial Sequence
  Synthetic
aucauuaucucuauuuua

SEQ ID NO: 18083 - RNA, 19 nt, Artificial Sequence
  Synthetic
caucauuaucucuauuuua

SEQ ID NO: 18084 - RNA, 20 nt, Artificial Sequence
  Synthetic
gcaucauuaucucuauuuua

SEQ ID NO: 18085 - RNA, 21 nt, Artificial Sequence
  Synthetic
agcaucauuaucucuauuuua

SEQ ID NO: 18086 - RNA, 22 nt, Artificial Sequence
  Synthetic
aagcaucauuaucucuauuuua

SEQ ID NO: 18087 - RNA, 23 nt, Artificial Sequence
  Synthetic
aaagcaucauuaucucuauuuua

SEQ ID NO: 18088 - RNA, 24 nt, Artificial Sequence
  Synthetic
gaaagcaucauuaucucuauuuua

SEQ ID NO: 18089 - RNA, 18 nt, Artificial Sequence
  Synthetic
uacauugcccagggucac

SEQ ID NO: 18090 - RNA, 19 nt, Artificial Sequence
  Synthetic
cuacauugcccagggucac

SEQ ID NO: 18091 - RNA, 20 nt, Artificial Sequence
  Synthetic
acuacauugcccagggucac

SEQ ID NO: 18092 - RNA, 21 nt, Artificial Sequence
  Synthetic
aacuacauugcccagggucac

SEQ ID NO: 18093 - RNA, 22 nt, Artificial Sequence
  Synthetic
aaacuacauugcccagggucac

SEQ ID NO: 18094 - RNA, 23 nt, Artificial Sequence
  Synthetic
aaaacuacauugcccagggucac

SEQ ID NO: 18095 - RNA, 24 nt, Artificial Sequence
  Synthetic
uaaaacuacauugcccagggucac

SEQ ID NO: 18096 - RNA, 18 nt, Artificial Sequence
  Synthetic
ccugguaugugguccuac

SEQ ID NO: 18097 - RNA, 19 nt, Artificial Sequence
  Synthetic
gccugguaugugguccuac

SEQ ID NO: 18098 - RNA, 20 nt, Artificial Sequence
  Synthetic
ggccugguaugugguccuac

SEQ ID NO: 18099 - RNA, 21 nt, Artificial Sequence
  Synthetic
gggccugguaugugguccuac

SEQ ID NO: 18100 - RNA, 22 nt, Artificial Sequence
  Synthetic
ugggccugguaugugguccuac

SEQ ID NO: 18101 - RNA, 23 nt, Artificial Sequence
  Synthetic
cugggccugguaugugguccuac

SEQ ID NO: 18102 - RNA, 24 nt, Artificial Sequence
  Synthetic
ucugggccugguaugugguccuac

SEQ ID NO: 18103 - RNA, 18 nt, Artificial Sequence
  Synthetic
uuugucuuauuagagacc

SEQ ID NO: 18104 - RNA, 19 nt, Artificial Sequence
  Synthetic
auuugucuuauuagagacc

SEQ ID NO: 18105 - RNA, 20 nt, Artificial Sequence
  Synthetic
aauuugucuuauuagagacc

SEQ ID NO: 18106 - RNA, 21 nt, Artificial Sequence
  Synthetic
gaauuugucuuauuagagacc

SEQ ID NO: 18107 - RNA, 22 nt, Artificial Sequence
  Synthetic
agaauuugucuuauuagagacc

SEQ ID NO: 18108 - RNA, 23 nt, Artificial Sequence
  Synthetic
gagaauuugucuuauuagagacc

SEQ ID NO: 18109 - RNA, 24 nt, Artificial Sequence
  Synthetic
agagaauuugucuuauuagagacc

SEQ ID NO: 18110 - RNA, 18 nt, Artificial Sequence
  Synthetic
cuccuaucuuuaaggacc

SEQ ID NO: 18111 - RNA, 19 nt, Artificial Sequence
  Synthetic
gcuccuaucuuuaaggacc

SEQ ID NO: 18112 - RNA, 20 nt, Artificial Sequence
  Synthetic
ugcuccuaucuuuaaggacc

SEQ ID NO: 18113 - RNA, 21 nt, Artificial Sequence
  Synthetic
uugcuccuaucuuuaaggacc

SEQ ID NO: 18114 - RNA, 22 nt, Artificial Sequence
  Synthetic
uuugcuccuaucuuuaaggacc

SEQ ID NO: 18115 - RNA, 23 nt, Artificial Sequence
  Synthetic
cuuugcuccuaucuuuaaggacc

SEQ ID NO: 18116 - RNA, 24 nt, Artificial Sequence
  Synthetic
ucuuugcuccuaucuuuaaggacc

SEQ ID NO: 18117 - RNA, 18 nt, Artificial Sequence
  Synthetic
uaggaacucaaugggacc

SEQ ID NO: 18118 - RNA, 19 nt, Artificial Sequence
  Synthetic
uuaggaacucaaugggacc

SEQ ID NO: 18119 - RNA, 20 nt, Artificial Sequence
  Synthetic
cuuaggaacucaaugggacc

SEQ ID NO: 18120 - RNA, 21 nt, Artificial Sequence
  Synthetic
ccuuaggaacucaaugggacc

SEQ ID NO: 18121 - RNA, 22 nt, Artificial Sequence
  Synthetic
gccuuaggaacucaaugggacc

SEQ ID NO: 18122 - RNA, 23 nt, Artificial Sequence
  Synthetic
ggccuuaggaacucaaugggacc

SEQ ID NO: 18123 - RNA, 24 nt, Artificial Sequence
  Synthetic
uggccuuaggaacucaaugggacc

SEQ ID NO: 18124 - RNA, 18 nt, Artificial Sequence
  Synthetic
cuuuguaccucugcaccc

SEQ ID NO: 18125 - RNA, 19 nt, Artificial Sequence
  Synthetic
acuuuguaccucugcaccc

SEQ ID NO: 18126 - RNA, 20 nt, Artificial Sequence
  Synthetic
uacuuuguaccucugcaccc

SEQ ID NO: 18127 - RNA, 21 nt, Artificial Sequence
  Synthetic
guacuuuguaccucugcaccc

SEQ ID NO: 18128 - RNA, 22 nt, Artificial Sequence
  Synthetic
gguacuuuguaccucugcaccc

SEQ ID NO: 18129 - RNA, 23 nt, Artificial Sequence
  Synthetic
ugguacuuuguaccucugcaccc

SEQ ID NO: 18130 - RNA, 24 nt, Artificial Sequence
  Synthetic
uugguacuuuguaccucugcaccc

SEQ ID NO: 18131 - RNA, 18 nt, Artificial Sequence
  Synthetic
agucauagugcuuacccc

SEQ ID NO: 18132 - RNA, 19 nt, Artificial Sequence
  Synthetic
gagucauagugcuuacccc

SEQ ID NO: 18133 - RNA, 20 nt, Artificial Sequence
  Synthetic
ugagucauagugcuuacccc

SEQ ID NO: 18134 - RNA, 21 nt, Artificial Sequence
  Synthetic
uugagucauagugcuuacccc

SEQ ID NO: 18135 - RNA, 22 nt, Artificial Sequence
  Synthetic
cuugagucauagugcuuacccc

SEQ ID NO: 18136 - RNA, 23 nt, Artificial Sequence
  Synthetic
ucuugagucauagugcuuacccc

SEQ ID NO: 18137 - RNA, 24 nt, Artificial Sequence
  Synthetic
cucuugagucauagugcuuacccc

SEQ ID NO: 18138 - RNA, 18 nt, Artificial Sequence
  Synthetic
gaauacaaauguacuccc

SEQ ID NO: 18139 - RNA, 19 nt, Artificial Sequence
  Synthetic
ugaauacaaauguacuccc

SEQ ID NO: 18140 - RNA, 21 nt, Artificial Sequence
  Synthetic
uuugaauacaaauguacuccc

SEQ ID NO: 18141 - RNA, 22 nt, Artificial Sequence
  Synthetic
auuugaauacaaauguacuccc

SEQ ID NO: 18142 - RNA, 23 nt, Artificial Sequence
  Synthetic
uauuugaauacaaauguacuccc

SEQ ID NO: 18143 - RNA, 24 nt, Artificial Sequence
  Synthetic
auauuugaauacaaauguacuccc

SEQ ID NO: 18144 - RNA, 18 nt, Artificial Sequence
  Synthetic
uuggugugugcaaaugcc

SEQ ID NO: 18145 - RNA, 19 nt, Artificial Sequence
  Synthetic
cuuggugugugcaaaugcc

SEQ ID NO: 18146 - RNA, 20 nt, Artificial Sequence
  Synthetic
acuuggugugugcaaaugcc

SEQ ID NO: 18147 - RNA, 21 nt, Artificial Sequence
  Synthetic
cacuuggugugugcaaaugcc

SEQ ID NO: 18148 - RNA, 22 nt, Artificial Sequence
  Synthetic
acacuuggugugugcaaaugcc

SEQ ID NO: 18149 - RNA, 23 nt, Artificial Sequence
  Synthetic
aacacuuggugugugcaaaugcc

SEQ ID NO: 18150 - RNA, 24 nt, Artificial Sequence
  Synthetic
gaacacuuggugugugcaaaugcc

SEQ ID NO: 18151 - RNA, 18 nt, Artificial Sequence
  Synthetic
gcuaaaugugaaaaaucc

SEQ ID NO: 18152 - RNA, 19 nt, Artificial Sequence
  Synthetic
ggcuaaaugugaaaaaucc

SEQ ID NO: 18153 - RNA, 20 nt, Artificial Sequence
  Synthetic
uggcuaaaugugaaaaaucc

SEQ ID NO: 18154 - RNA, 21 nt, Artificial Sequence
  Synthetic
uuggcuaaaugugaaaaaucc

SEQ ID NO: 18155 - RNA, 22 nt, Artificial Sequence
  Synthetic
cuuggcuaaaugugaaaaaucc

SEQ ID NO: 18156 - RNA, 23 nt, Artificial Sequence
  Synthetic
ccuuggcuaaaugugaaaaaucc

SEQ ID NO: 18157 - RNA, 24 nt, Artificial Sequence
  Synthetic
uccuuggcuaaaugugaaaaaucc

SEQ ID NO: 18158 - RNA, 18 nt, Artificial Sequence
  Synthetic
ugaauacaaauguacucc

SEQ ID NO: 18159 - RNA, 19 nt, Artificial Sequence
  Synthetic
uugaauacaaauguacucc

SEQ ID NO: 18160 - RNA, 20 nt, Artificial Sequence
  Synthetic
uuugaauacaaauguacucc

SEQ ID NO: 18161 - RNA, 21 nt, Artificial Sequence
  Synthetic
auuugaauacaaauguacucc

SEQ ID NO: 18162 - RNA, 22 nt, Artificial Sequence
  Synthetic
uauuugaauacaaauguacucc

SEQ ID NO: 18163 - RNA, 23 nt, Artificial Sequence
  Synthetic
auauuugaauacaaauguacucc

SEQ ID NO: 18164 - RNA, 24 nt, Artificial Sequence
  Synthetic
uauauuugaauacaaauguacucc

SEQ ID NO: 18165 - RNA, 18 nt, Artificial Sequence
  Synthetic
uuuauuggcucaugaagc

SEQ ID NO: 18166 - RNA, 19 nt, Artificial Sequence
  Synthetic
auuuauuggcucaugaagc

SEQ ID NO: 18167 - RNA, 20 nt, Artificial Sequence
  Synthetic
aauuuauuggcucaugaagc

SEQ ID NO: 18168 - RNA, 21 nt, Artificial Sequence
  Synthetic
gaauuuauuggcucaugaagc

SEQ ID NO: 18169 - RNA, 22 nt, Artificial Sequence
  Synthetic
cgaauuuauuggcucaugaagc

SEQ ID NO: 18170 - RNA, 23 nt, Artificial Sequence
  Synthetic
acgaauuuauuggcucaugaagc

SEQ ID NO: 18171 - RNA, 24 nt, Artificial Sequence
  Synthetic
aacgaauuuauuggcucaugaagc

SEQ ID NO: 18172 - RNA, 18 nt, Artificial Sequence
  Synthetic
cucagucuccugaguagc

SEQ ID NO: 18173 - RNA, 19 nt, Artificial Sequence
  Synthetic
ucucagucuccugaguagc

SEQ ID NO: 18174 - RNA, 21 nt, Artificial Sequence
  Synthetic
aaucucagucuccugaguagc

SEQ ID NO: 18175 - RNA, 22 nt, Artificial Sequence
  Synthetic
gaaucucagucuccugaguagc

SEQ ID NO: 18176 - RNA, 23 nt, Artificial Sequence
  Synthetic
cgaaucucagucuccugaguagc

SEQ ID NO: 18177 - RNA, 24 nt, Artificial Sequence
  Synthetic
gcgaaucucagucuccugaguagc

SEQ ID NO: 18178 - RNA, 18 nt, Artificial Sequence
  Synthetic
aguguugggauuaguggc

SEQ ID NO: 18179 - RNA, 19 nt, Artificial Sequence
  Synthetic
aaguguugggauuaguggc

SEQ ID NO: 18180 - RNA, 20 nt, Artificial Sequence
  Synthetic
aaaguguugggauuaguggc

SEQ ID NO: 18181 - RNA, 21 nt, Artificial Sequence
  Synthetic
caaaguguugggauuaguggc

SEQ ID NO: 18182 - RNA, 22 nt, Artificial Sequence
  Synthetic
ccaaaguguugggauuaguggc

SEQ ID NO: 18183 - RNA, 23 nt, Artificial Sequence
  Synthetic
cccaaaguguugggauuaguggc

SEQ ID NO: 18184 - RNA, 24 nt, Artificial Sequence
  Synthetic
ucccaaaguguugggauuaguggc

SEQ ID NO: 18185 - RNA, 18 nt, Artificial Sequence
  Synthetic
agaaaccuguagcauugc

SEQ ID NO: 18186 - RNA, 19 nt, Artificial Sequence
  Synthetic
uagaaaccuguagcauugc

SEQ ID NO: 18187 - RNA, 21 nt, Artificial Sequence
  Synthetic
cauagaaaccuguagcauugc

SEQ ID NO: 18188 - RNA, 22 nt, Artificial Sequence
  Synthetic
acauagaaaccuguagcauugc

SEQ ID NO: 18189 - RNA, 23 nt, Artificial Sequence
  Synthetic
uacauagaaaccuguagcauugc

SEQ ID NO: 18190 - RNA, 24 nt, Artificial Sequence
  Synthetic
uuacauagaaaccuguagcauugc

SEQ ID NO: 18191 - RNA, 18 nt, Artificial Sequence
  Synthetic
auucacacuucuaagauc

SEQ ID NO: 18192 - RNA, 19 nt, Artificial Sequence
  Synthetic
gauucacacuucuaagauc

SEQ ID NO: 18193 - RNA, 20 nt, Artificial Sequence
  Synthetic
agauucacacuucuaagauc

SEQ ID NO: 18194 - RNA, 21 nt, Artificial Sequence
  Synthetic
cagauucacacuucuaagauc

SEQ ID NO: 18195 - RNA, 22 nt, Artificial Sequence
  Synthetic
gcagauucacacuucuaagauc

SEQ ID NO: 18196 - RNA, 23 nt, Artificial Sequence
  Synthetic
agcagauucacacuucuaagauc

SEQ ID NO: 18197 - RNA, 24 nt, Artificial Sequence
  Synthetic
uagcagauucacacuucuaagauc

SEQ ID NO: 18198 - RNA, 18 nt, Artificial Sequence
  Synthetic
ucauuuacaucucagcuc

SEQ ID NO: 18199 - RNA, 19 nt, Artificial Sequence
  Synthetic
uucauuuacaucucagcuc

SEQ ID NO: 18200 - RNA, 20 nt, Artificial Sequence
  Synthetic
uuucauuuacaucucagcuc

SEQ ID NO: 18201 - RNA, 21 nt, Artificial Sequence
  Synthetic
cuuucauuuacaucucagcuc

SEQ ID NO: 18202 - RNA, 22 nt, Artificial Sequence
  Synthetic
acuuucauuuacaucucagcuc

SEQ ID NO: 18203 - RNA, 23 nt, Artificial Sequence
  Synthetic
cacuuucauuuacaucucagcuc

SEQ ID NO: 18204 - RNA, 24 nt, Artificial Sequence
  Synthetic
ucacuuucauuuacaucucagcuc

SEQ ID NO: 18205 - RNA, 18 nt, Artificial Sequence
  Synthetic
gaacgaauuuauuggcuc

SEQ ID NO: 18206 - RNA, 19 nt, Artificial Sequence
  Synthetic
ggaacgaauuuauuggcuc

SEQ ID NO: 18207 - RNA, 20 nt, Artificial Sequence
  Synthetic
aggaacgaauuuauuggcuc

SEQ ID NO: 18208 - RNA, 21 nt, Artificial Sequence
  Synthetic
aaggaacgaauuuauuggcuc

SEQ ID NO: 18209 - RNA, 22 nt, Artificial Sequence
  Synthetic
aaaggaacgaauuuauuggcuc

SEQ ID NO: 18210 - RNA, 23 nt, Artificial Sequence
  Synthetic
aaaaggaacgaauuuauuggcuc

SEQ ID NO: 18211 - RNA, 24 nt, Artificial Sequence
  Synthetic
uaaaaggaacgaauuuauuggcuc

SEQ ID NO: 18212 - RNA, 18 nt, Artificial Sequence
  Synthetic
cuguauugccuugcucuc

SEQ ID NO: 18213 - RNA, 19 nt, Artificial Sequence
  Synthetic
ucuguauugccuugcucuc

SEQ ID NO: 18214 - RNA, 20 nt, Artificial Sequence
  Synthetic
gucuguauugccuugcucuc

SEQ ID NO: 18215 - RNA, 21 nt, Artificial Sequence
  Synthetic
ggucuguauugccuugcucuc

SEQ ID NO: 18216 - RNA, 22 nt, Artificial Sequence
  Synthetic
aggucuguauugccuugcucuc

SEQ ID NO: 18217 - RNA, 23 nt, Artificial Sequence
  Synthetic
gaggucuguauugccuugcucuc

SEQ ID NO: 18218 - RNA, 24 nt, Artificial Sequence
  Synthetic
ugaggucuguauugccuugcucuc

SEQ ID NO: 18219 - RNA, 18 nt, Artificial Sequence
  Synthetic
augcuggccaggcugguc

SEQ ID NO: 18220 - RNA, 19 nt, Artificial Sequence
  Synthetic
uaugcuggccaggcugguc

SEQ ID NO: 18221 - RNA, 20 nt, Artificial Sequence
  Synthetic
cuaugcuggccaggcugguc

SEQ ID NO: 18222 - RNA, 21 nt, Artificial Sequence
  Synthetic
gcuaugcuggccaggcugguc

SEQ ID NO: 18223 - RNA, 22 nt, Artificial Sequence
  Synthetic
ugcuaugcuggccaggcugguc

SEQ ID NO: 18224 - RNA, 23 nt, Artificial Sequence
  Synthetic
uugcuaugcuggccaggcugguc

SEQ ID NO: 18225 - RNA, 24 nt, Artificial Sequence
  Synthetic
uuugcuaugcuggccaggcugguc

SEQ ID NO: 18226 - RNA, 18 nt, Artificial Sequence
  Synthetic
auguuggccaggcugguc

SEQ ID NO: 18227 - RNA, 19 nt, Artificial Sequence
  Synthetic
cauguuggccaggcugguc

SEQ ID NO: 18228 - RNA, 20 nt, Artificial Sequence
  Synthetic
ccauguuggccaggcugguc

SEQ ID NO: 18229 - RNA, 21 nt, Artificial Sequence
  Synthetic
gccauguuggccaggcugguc

SEQ ID NO: 18230 - RNA, 22 nt, Artificial Sequence
  Synthetic
cgccauguuggccaggcugguc

SEQ ID NO: 18231 - RNA, 23 nt, Artificial Sequence
  Synthetic
ucgccauguuggccaggcugguc

SEQ ID NO: 18232 - RNA, 24 nt, Artificial Sequence
  Synthetic
uucgccauguuggccaggcugguc

SEQ ID NO: 18233 - RNA, 18 nt, Artificial Sequence
  Synthetic
cucucauuagcaagcuuc

SEQ ID NO: 18234 - RNA, 19 nt, Artificial Sequence
  Synthetic
gcucucauuagcaagcuuc

SEQ ID NO: 18235 - RNA, 20 nt, Artificial Sequence
  Synthetic
ggcucucauuagcaagcuuc

SEQ ID NO: 18236 - RNA, 21 nt, Artificial Sequence
  Synthetic
gggcucucauuagcaagcuuc

SEQ ID NO: 18237 - RNA, 22 nt, Artificial Sequence
  Synthetic
agggcucucauuagcaagcuuc

SEQ ID NO: 18238 - RNA, 23 nt, Artificial Sequence
  Synthetic
aagggcucucauuagcaagcuuc

SEQ ID NO: 18239 - RNA, 24 nt, Artificial Sequence
  Synthetic
gaagggcucucauuagcaagcuuc

SEQ ID NO: 18240 - RNA, 18 nt, Artificial Sequence
  Synthetic
aguucuuccuugugguuc

SEQ ID NO: 18241 - RNA, 19 nt, Artificial Sequence
  Synthetic
uaguucuuccuugugguuc

SEQ ID NO: 18242 - RNA, 20 nt, Artificial Sequence
  Synthetic
cuaguucuuccuugugguuc

SEQ ID NO: 18243 - RNA, 21 nt, Artificial Sequence
  Synthetic
ccuaguucuuccuugugguuc

SEQ ID NO: 18244 - RNA, 22 nt, Artificial Sequence
  Synthetic
accuaguucuuccuugugguuc

SEQ ID NO: 18245 - RNA, 23 nt, Artificial Sequence
  Synthetic
uaccuaguucuuccuugugguuc

SEQ ID NO: 18246 - RNA, 24 nt, Artificial Sequence
  Synthetic
uuaccuaguucuuccuugugguuc

SEQ ID NO: 18247 - RNA, 18 nt, Artificial Sequence
  Synthetic
ucugugugugagagaaag

SEQ ID NO: 18248 - RNA, 19 nt, Artificial Sequence
  Synthetic
cucugugugugagagaaag

SEQ ID NO: 18249 - RNA, 20 nt, Artificial Sequence
  Synthetic
gcucugugugugagagaaag

SEQ ID NO: 18250 - RNA, 21 nt, Artificial Sequence
  Synthetic
agcucugugugugagagaaag

SEQ ID NO: 18251 - RNA, 22 nt, Artificial Sequence
  Synthetic
uagcucugugugugagagaaag

SEQ ID NO: 18252 - RNA, 23 nt, Artificial Sequence
  Synthetic
uuagcucugugugugagagaaag

SEQ ID NO: 18253 - RNA, 24 nt, Artificial Sequence
  Synthetic
guuagcucugugugugagagaaag

SEQ ID NO: 18254 - RNA, 18 nt, Artificial Sequence
  Synthetic
cuuuaaggaccacgaaag

SEQ ID NO: 18255 - RNA, 19 nt, Artificial Sequence
  Synthetic
ucuuuaaggaccacgaaag

SEQ ID NO: 18256 - RNA, 20 nt, Artificial Sequence
  Synthetic
aucuuuaaggaccacgaaag

SEQ ID NO: 18257 - RNA, 21 nt, Artificial Sequence
  Synthetic
uaucuuuaaggaccacgaaag

SEQ ID NO: 18258 - RNA, 22 nt, Artificial Sequence
  Synthetic
cuaucuuuaaggaccacgaaag

SEQ ID NO: 18259 - RNA, 23 nt, Artificial Sequence
  Synthetic
ccuaucuuuaaggaccacgaaag

SEQ ID NO: 18260 - RNA, 24 nt, Artificial Sequence
  Synthetic
uccuaucuuuaaggaccacgaaag

SEQ ID NO: 18261 - RNA, 18 nt, Artificial Sequence
  Synthetic
auggagccaugauuccag

SEQ ID NO: 18262 - RNA, 19 nt, Artificial Sequence
  Synthetic
gauggagccaugauuccag

SEQ ID NO: 18263 - RNA, 20 nt, Artificial Sequence
  Synthetic
ugauggagccaugauuccag

SEQ ID NO: 18264 - RNA, 21 nt, Artificial Sequence
  Synthetic
augauggagccaugauuccag

SEQ ID NO: 18265 - RNA, 22 nt, Artificial Sequence
  Synthetic
aaugauggagccaugauuccag

SEQ ID NO: 18266 - RNA, 23 nt, Artificial Sequence
  Synthetic
gaaugauggagccaugauuccag

SEQ ID NO: 18267 - RNA, 24 nt, Artificial Sequence
  Synthetic
ugaaugauggagccaugauuccag

SEQ ID NO: 18268 - RNA, 18 nt, Artificial Sequence
  Synthetic
gggaaugauuaaucagag

SEQ ID NO: 18269 - RNA, 19 nt, Artificial Sequence
  Synthetic
agggaaugauuaaucagag

SEQ ID NO: 18270 - RNA, 20 nt, Artificial Sequence
  Synthetic
gagggaaugauuaaucagag

SEQ ID NO: 18271 - RNA, 21 nt, Artificial Sequence
  Synthetic
ugagggaaugauuaaucagag

SEQ ID NO: 18272 - RNA, 22 nt, Artificial Sequence
  Synthetic
cugagggaaugauuaaucagag

SEQ ID NO: 18273 - RNA, 23 nt, Artificial Sequence
  Synthetic
gcugagggaaugauuaaucagag

SEQ ID NO: 18274 - RNA, 24 nt, Artificial Sequence
  Synthetic
ugcugagggaaugauuaaucagag

SEQ ID NO: 18275 - RNA, 18 nt, Artificial Sequence
  Synthetic
uggcuaauuuuuguagag

SEQ ID NO: 18276 - RNA, 19 nt, Artificial Sequence
  Synthetic
cuggcuaauuuuuguagag

SEQ ID NO: 18277 - RNA, 20 nt, Artificial Sequence
  Synthetic
ccuggcuaauuuuuguagag

SEQ ID NO: 18278 - RNA, 21 nt, Artificial Sequence
  Synthetic
gccuggcuaauuuuuguagag

SEQ ID NO: 18279 - RNA, 22 nt, Artificial Sequence
  Synthetic
ggccuggcuaauuuuuguagag

SEQ ID NO: 18280 - RNA, 23 nt, Artificial Sequence
  Synthetic
aggccuggcuaauuuuuguagag

SEQ ID NO: 18281 - RNA, 24 nt, Artificial Sequence
  Synthetic
caggccuggcuaauuuuuguagag

SEQ ID NO: 18282 - RNA, 18 nt, Artificial Sequence
  Synthetic
ccucucagccacucugag

SEQ ID NO: 18283 - RNA, 19 nt, Artificial Sequence
  Synthetic
uccucucagccacucugag

SEQ ID NO: 18284 - RNA, 21 nt, Artificial Sequence
  Synthetic
ucuccucucagccacucugag

SEQ ID NO: 18285 - RNA, 22 nt, Artificial Sequence
  Synthetic
aucuccucucagccacucugag

SEQ ID NO: 18286 - RNA, 23 nt, Artificial Sequence
  Synthetic
uaucuccucucagccacucugag

SEQ ID NO: 18287 - RNA, 24 nt, Artificial Sequence
  Synthetic
auaucuccucucagccacucugag

SEQ ID NO: 18288 - RNA, 18 nt, Artificial Sequence
  Synthetic
auguggggagggaaauag

SEQ ID NO: 18289 - RNA, 19 nt, Artificial Sequence
  Synthetic
cauguggggagggaaauag

SEQ ID NO: 18290 - RNA, 20 nt, Artificial Sequence
  Synthetic
gcauguggggagggaaauag

SEQ ID NO: 18291 - RNA, 21 nt, Artificial Sequence
  Synthetic
agcauguggggagggaaauag

SEQ ID NO: 18292 - RNA, 22 nt, Artificial Sequence
  Synthetic
aagcauguggggagggaaauag

SEQ ID NO: 18293 - RNA, 23 nt, Artificial Sequence
  Synthetic
gaagcauguggggagggaaauag

SEQ ID NO: 18294 - RNA, 24 nt, Artificial Sequence
  Synthetic
agaagcauguggggagggaaauag

SEQ ID NO: 18295 - RNA, 18 nt, Artificial Sequence
  Synthetic
gguaauuaggcuuuauag

SEQ ID NO: 18296 - RNA, 19 nt, Artificial Sequence
  Synthetic
agguaauuaggcuuuauag

SEQ ID NO: 18297 - RNA, 20 nt, Artificial Sequence
  Synthetic
aagguaauuaggcuuuauag

SEQ ID NO: 18298 - RNA, 21 nt, Artificial Sequence
  Synthetic
aaagguaauuaggcuuuauag

SEQ ID NO: 18299 - RNA, 22 nt, Artificial Sequence
  Synthetic
aaaagguaauuaggcuuuauag

SEQ ID NO: 18300 - RNA, 23 nt, Artificial Sequence
  Synthetic
gaaaagguaauuaggcuuuauag

SEQ ID NO: 18301 - RNA, 24 nt, Artificial Sequence
  Synthetic
ggaaaagguaauuaggcuuuauag

SEQ ID NO: 18302 - RNA, 18 nt, Artificial Sequence
  Synthetic
aacuaugugaagaccuag

SEQ ID NO: 18303 - RNA, 19 nt, Artificial Sequence
  Synthetic
gaacuaugugaagaccuag

SEQ ID NO: 18304 - RNA, 20 nt, Artificial Sequence
  Synthetic
ugaacuaugugaagaccuag

SEQ ID NO: 18305 - RNA, 21 nt, Artificial Sequence
  Synthetic
cugaacuaugugaagaccuag

SEQ ID NO: 18306 - RNA, 22 nt, Artificial Sequence
  Synthetic
ccugaacuaugugaagaccuag

SEQ ID NO: 18307 - RNA, 23 nt, Artificial Sequence
  Synthetic
gccugaacuaugugaagaccuag

SEQ ID NO: 18308 - RNA, 24 nt, Artificial Sequence
  Synthetic
agccugaacuaugugaagaccuag

SEQ ID NO: 18309 - RNA, 18 nt, Artificial Sequence
  Synthetic
uucaaagaauuaagcuag

SEQ ID NO: 18310 - RNA, 19 nt, Artificial Sequence
  Synthetic
auucaaagaauuaagcuag

SEQ ID NO: 18311 - RNA, 21 nt, Artificial Sequence
  Synthetic
uuauucaaagaauuaagcuag

SEQ ID NO: 18312 - RNA, 22 nt, Artificial Sequence
  Synthetic
uuuauucaaagaauuaagcuag

SEQ ID NO: 18313 - RNA, 23 nt, Artificial Sequence
  Synthetic
uuuuauucaaagaauuaagcuag

SEQ ID NO: 18314 - RNA, 24 nt, Artificial Sequence
  Synthetic
auuuuauucaaagaauuaagcuag

SEQ ID NO: 18315 - RNA, 18 nt, Artificial Sequence
  Synthetic
ucucagucuccugaguag

SEQ ID NO: 18316 - RNA, 19 nt, Artificial Sequence
  Synthetic
aucucagucuccugaguag

SEQ ID NO: 18317 - RNA, 20 nt, Artificial Sequence
  Synthetic
aaucucagucuccugaguag

SEQ ID NO: 18318 - RNA, 21 nt, Artificial Sequence
  Synthetic
gaaucucagucuccugaguag

SEQ ID NO: 18319 - RNA, 22 nt, Artificial Sequence
  Synthetic
cgaaucucagucuccugaguag

SEQ ID NO: 18320 - RNA, 23 nt, Artificial Sequence
  Synthetic
gcgaaucucagucuccugaguag

SEQ ID NO: 18321 - RNA, 24 nt, Artificial Sequence
  Synthetic
agcgaaucucagucuccugaguag

SEQ ID NO: 18322 - RNA, 18 nt, Artificial Sequence
  Synthetic
aauacaugauuuuaguag

SEQ ID NO: 18323 - RNA, 19 nt, Artificial Sequence
  Synthetic
uaauacaugauuuuaguag

SEQ ID NO: 18324 - RNA, 20 nt, Artificial Sequence
  Synthetic
uuaauacaugauuuuaguag

SEQ ID NO: 18325 - RNA, 21 nt, Artificial Sequence
  Synthetic
uuuaauacaugauuuuaguag

SEQ ID NO: 18326 - RNA, 22 nt, Artificial Sequence
  Synthetic
cuuuaauacaugauuuuaguag

SEQ ID NO: 18327 - RNA, 23 nt, Artificial Sequence
  Synthetic
ccuuuaauacaugauuuuaguag

SEQ ID NO: 18328 - RNA, 24 nt, Artificial Sequence
  Synthetic
accuuuaauacaugauuuuaguag

SEQ ID NO: 18329 - RNA, 18 nt, Artificial Sequence
  Synthetic
cugugugugagagaaagg

SEQ ID NO: 18330 - RNA, 19 nt, Artificial Sequence
  Synthetic
ucugugugugagagaaagg

SEQ ID NO: 18331 - RNA, 21 nt, Artificial Sequence
  Synthetic
gcucugugugugagagaaagg

SEQ ID NO: 18332 - RNA, 22 nt, Artificial Sequence
  Synthetic
agcucugugugugagagaaagg

SEQ ID NO: 18333 - RNA, 23 nt, Artificial Sequence
  Synthetic
uagcucugugugugagagaaagg

SEQ ID NO: 18334 - RNA, 24 nt, Artificial Sequence
  Synthetic
uuagcucugugugugagagaaagg

SEQ ID NO: 18335 - RNA, 18 nt, Artificial Sequence
  Synthetic
cucgcugugucacccagg

SEQ ID NO: 18336 - RNA, 19 nt, Artificial Sequence
  Synthetic
ucucgcugugucacccagg

SEQ ID NO: 18337 - RNA, 20 nt, Artificial Sequence
  Synthetic
gucucgcugugucacccagg

SEQ ID NO: 18338 - RNA, 21 nt, Artificial Sequence
  Synthetic
agucucgcugugucacccagg

SEQ ID NO: 18339 - RNA, 22 nt, Artificial Sequence
  Synthetic
gagucucgcugugucacccagg

SEQ ID NO: 18340 - RNA, 23 nt, Artificial Sequence
  Synthetic
agagucucgcugugucacccagg

SEQ ID NO: 18341 - RNA, 24 nt, Artificial Sequence
  Synthetic
cagagucucgcugugucacccagg

SEQ ID NO: 18342 - RNA, 18 nt, Artificial Sequence
  Synthetic
cuugcucuguugcccagg

SEQ ID NO: 18343 - RNA, 19 nt, Artificial Sequence
  Synthetic
ucuugcucuguugcccagg

SEQ ID NO: 18344 - RNA, 20 nt, Artificial Sequence
  Synthetic
gucuugcucuguugcccagg

SEQ ID NO: 18345 - RNA, 21 nt, Artificial Sequence
  Synthetic
agucuugcucuguugcccagg

SEQ ID NO: 18346 - RNA, 22 nt, Artificial Sequence
  Synthetic
gagucuugcucuguugcccagg

SEQ ID NO: 18347 - RNA, 23 nt, Artificial Sequence
  Synthetic
agagucuugcucuguugcccagg

SEQ ID NO: 18348 - RNA, 24 nt, Artificial Sequence
  Synthetic
cagagucuugcucuguugcccagg

SEQ ID NO: 18349 - RNA, 18 nt, Artificial Sequence
  Synthetic
ugugcaaaugccaugagg

SEQ ID NO: 18350 - RNA, 19 nt, Artificial Sequence
  Synthetic
gugugcaaaugccaugagg

SEQ ID NO: 18351 - RNA, 20 nt, Artificial Sequence
  Synthetic
ugugugcaaaugccaugagg

SEQ ID NO: 18352 - RNA, 21 nt, Artificial Sequence
  Synthetic
gugugugcaaaugccaugagg

SEQ ID NO: 18353 - RNA, 22 nt, Artificial Sequence
  Synthetic
ggugugugcaaaugccaugagg

SEQ ID NO: 18354 - RNA, 23 nt, Artificial Sequence
  Synthetic
uggugugugcaaaugccaugagg

SEQ ID NO: 18355 - RNA, 24 nt, Artificial Sequence
  Synthetic
uuggugugugcaaaugccaugagg

SEQ ID NO: 18356 - RNA, 18 nt, Artificial Sequence
  Synthetic
acuaugugaagaccuagg

SEQ ID NO: 18357 - RNA, 19 nt, Artificial Sequence
  Synthetic
aacuaugugaagaccuagg

SEQ ID NO: 18358 - RNA, 21 nt, Artificial Sequence
  Synthetic
ugaacuaugugaagaccuagg

SEQ ID NO: 18359 - RNA, 22 nt, Artificial Sequence
  Synthetic
cugaacuaugugaagaccuagg

SEQ ID NO: 18360 - RNA, 23 nt, Artificial Sequence
  Synthetic
ccugaacuaugugaagaccuagg

SEQ ID NO: 18361 - RNA, 24 nt, Artificial Sequence
  Synthetic
gccugaacuaugugaagaccuagg

SEQ ID NO: 18362 - RNA, 18 nt, Artificial Sequence
  Synthetic
guggagaagcaugugggg

SEQ ID NO: 18363 - RNA, 19 nt, Artificial Sequence
  Synthetic
gguggagaagcaugugggg

SEQ ID NO: 18364 - RNA, 21 nt, Artificial Sequence
  Synthetic
aagguggagaagcaugugggg

SEQ ID NO: 18365 - RNA, 22 nt, Artificial Sequence
  Synthetic
aaagguggagaagcaugugggg

SEQ ID NO: 18366 - RNA, 23 nt, Artificial Sequence
  Synthetic
gaaagguggagaagcaugugggg

SEQ ID NO: 18367 - RNA, 24 nt, Artificial Sequence
  Synthetic
agaaagguggagaagcaugugggg

SEQ ID NO: 18368 - RNA, 18 nt, Artificial Sequence
  Synthetic
gguggagaagcauguggg

SEQ ID NO: 18369 - RNA, 19 nt, Artificial Sequence
  Synthetic
agguggagaagcauguggg

SEQ ID NO: 18370 - RNA, 20 nt, Artificial Sequence
  Synthetic
aagguggagaagcauguggg

SEQ ID NO: 18371 - RNA, 21 nt, Artificial Sequence
  Synthetic
aaagguggagaagcauguggg

SEQ ID NO: 18372 - RNA, 22 nt, Artificial Sequence
  Synthetic
gaaagguggagaagcauguggg

SEQ ID NO: 18373 - RNA, 23 nt, Artificial Sequence
  Synthetic
agaaagguggagaagcauguggg

SEQ ID NO: 18374 - RNA, 24 nt, Artificial Sequence
  Synthetic
gagaaagguggagaagcauguggg

SEQ ID NO: 18375 - RNA, 18 nt, Artificial Sequence
  Synthetic
caagugguugccagaugg

SEQ ID NO: 18376 - RNA, 19 nt, Artificial Sequence
  Synthetic
ucaagugguugccagaugg

SEQ ID NO: 18377 - RNA, 20 nt, Artificial Sequence
  Synthetic
cucaagugguugccagaugg

SEQ ID NO: 18378 - RNA, 21 nt, Artificial Sequence
  Synthetic
ccucaagugguugccagaugg

SEQ ID NO: 18379 - RNA, 22 nt, Artificial Sequence
  Synthetic
cccucaagugguugccagaugg

SEQ ID NO: 18380 - RNA, 23 nt, Artificial Sequence
  Synthetic
gcccucaagugguugccagaugg

SEQ ID NO: 18381 - RNA, 24 nt, Artificial Sequence
  Synthetic
ggcccucaagugguugccagaugg

SEQ ID NO: 18382 - RNA, 18 nt, Artificial Sequence
  Synthetic
aguaaccaaauguuaugg

SEQ ID NO: 18383 - RNA, 19 nt, Artificial Sequence
  Synthetic
gaguaaccaaauguuaugg

SEQ ID NO: 18384 - RNA, 20 nt, Artificial Sequence
  Synthetic
ugaguaaccaaauguuaugg

SEQ ID NO: 18385 - RNA, 21 nt, Artificial Sequence
  Synthetic
cugaguaaccaaauguuaugg

SEQ ID NO: 18386 - RNA, 22 nt, Artificial Sequence
  Synthetic
ucugaguaaccaaauguuaugg

SEQ ID NO: 18387 - RNA, 23 nt, Artificial Sequence
  Synthetic
cucugaguaaccaaauguuaugg

SEQ ID NO: 18388 - RNA, 24 nt, Artificial Sequence
  Synthetic
acucugaguaaccaaauguuaugg

SEQ ID NO: 18389 - RNA, 18 nt, Artificial Sequence
  Synthetic
ccuuggccucccaaaaug

SEQ ID NO: 18390 - RNA, 19 nt, Artificial Sequence
  Synthetic
accuuggccucccaaaaug

SEQ ID NO: 18391 - RNA, 20 nt, Artificial Sequence
  Synthetic
caccuuggccucccaaaaug

SEQ ID NO: 18392 - RNA, 21 nt, Artificial Sequence
  Synthetic
ccaccuuggccucccaaaaug

SEQ ID NO: 18393 - RNA, 22 nt, Artificial Sequence
  Synthetic
cccaccuuggccucccaaaaug

SEQ ID NO: 18394 - RNA, 23 nt, Artificial Sequence
  Synthetic
gcccaccuuggccucccaaaaug

SEQ ID NO: 18395 - RNA, 24 nt, Artificial Sequence
  Synthetic
ugcccaccuuggccucccaaaaug

SEQ ID NO: 18396 - RNA, 18 nt, Artificial Sequence
  Synthetic
uuugccaguuaaugaaug

SEQ ID NO: 18397 - RNA, 19 nt, Artificial Sequence
  Synthetic
cuuugccaguuaaugaaug

SEQ ID NO: 18398 - RNA, 20 nt, Artificial Sequence
  Synthetic
acuuugccaguuaaugaaug

SEQ ID NO: 18399 - RNA, 21 nt, Artificial Sequence
  Synthetic
uacuuugccaguuaaugaaug

SEQ ID NO: 18400 - RNA, 22 nt, Artificial Sequence
  Synthetic
auacuuugccaguuaaugaaug

SEQ ID NO: 18401 - RNA, 23 nt, Artificial Sequence
  Synthetic
uauacuuugccaguuaaugaaug

SEQ ID NO: 18402 - RNA, 24 nt, Artificial Sequence
  Synthetic
auauacuuugccaguuaaugaaug

SEQ ID NO: 18403 - RNA, 18 nt, Artificial Sequence
  Synthetic
uuguugaaugaauccaug

SEQ ID NO: 18404 - RNA, 19 nt, Artificial Sequence
  Synthetic
uuuguugaaugaauccaug

SEQ ID NO: 18405 - RNA, 20 nt, Artificial Sequence
  Synthetic
auuuguugaaugaauccaug

SEQ ID NO: 18406 - RNA, 21 nt, Artificial Sequence
  Synthetic
uauuuguugaaugaauccaug

SEQ ID NO: 18407 - RNA, 22 nt, Artificial Sequence
  Synthetic
auauuuguugaaugaauccaug

SEQ ID NO: 18408 - RNA, 23 nt, Artificial Sequence
  Synthetic
aauauuuguugaaugaauccaug

SEQ ID NO: 18409 - RNA, 24 nt, Artificial Sequence
  Synthetic
aaauauuuguugaaugaauccaug

SEQ ID NO: 18410 - RNA, 18 nt, Artificial Sequence
  Synthetic
gaaagguggagaagcaug

SEQ ID NO: 18411 - RNA, 19 nt, Artificial Sequence
  Synthetic
agaaagguggagaagcaug

SEQ ID NO: 18412 - RNA, 21 nt, Artificial Sequence
  Synthetic
agagaaagguggagaagcaug

SEQ ID NO: 18413 - RNA, 22 nt, Artificial Sequence
  Synthetic
gagagaaagguggagaagcaug

SEQ ID NO: 18414 - RNA, 23 nt, Artificial Sequence
  Synthetic
ugagagaaagguggagaagcaug

SEQ ID NO: 18415 - RNA, 24 nt, Artificial Sequence
  Synthetic
gugagagaaagguggagaagcaug

SEQ ID NO: 18416 - RNA, 18 nt, Artificial Sequence
  Synthetic
cuaaguuuuaauuggaug

SEQ ID NO: 18417 - RNA, 19 nt, Artificial Sequence
  Synthetic
ucuaaguuuuaauuggaug

SEQ ID NO: 18418 - RNA, 20 nt, Artificial Sequence
  Synthetic
aucuaaguuuuaauuggaug

SEQ ID NO: 18419 - RNA, 21 nt, Artificial Sequence
  Synthetic
uaucuaaguuuuaauuggaug

SEQ ID NO: 18420 - RNA, 22 nt, Artificial Sequence
  Synthetic
auaucuaaguuuuaauuggaug

SEQ ID NO: 18421 - RNA, 23 nt, Artificial Sequence
  Synthetic
aauaucuaaguuuuaauuggaug

SEQ ID NO: 18422 - RNA, 24 nt, Artificial Sequence
  Synthetic
gaauaucuaaguuuuaauuggaug

SEQ ID NO: 18423 - RNA, 18 nt, Artificial Sequence
  Synthetic
uccauuucuccuuugaug

SEQ ID NO: 18424 - RNA, 19 nt, Artificial Sequence
  Synthetic
auccauuucuccuuugaug

SEQ ID NO: 18425 - RNA, 20 nt, Artificial Sequence
  Synthetic
gauccauuucuccuuugaug

SEQ ID NO: 18426 - RNA, 21 nt, Artificial Sequence
  Synthetic
ugauccauuucuccuuugaug

SEQ ID NO: 18427 - RNA, 22 nt, Artificial Sequence
  Synthetic
cugauccauuucuccuuugaug

SEQ ID NO: 18428 - RNA, 23 nt, Artificial Sequence
  Synthetic
ucugauccauuucuccuuugaug

SEQ ID NO: 18429 - RNA, 24 nt, Artificial Sequence
  Synthetic
aucugauccauuucuccuuugaug

SEQ ID NO: 18430 - RNA, 18 nt, Artificial Sequence
  Synthetic
uaaugggaauaaccacug

SEQ ID NO: 18431 - RNA, 19 nt, Artificial Sequence
  Synthetic
guaaugggaauaaccacug

SEQ ID NO: 18432 - RNA, 20 nt, Artificial Sequence
  Synthetic
aguaaugggaauaaccacug

SEQ ID NO: 18433 - RNA, 21 nt, Artificial Sequence
  Synthetic
caguaaugggaauaaccacug

SEQ ID NO: 18434 - RNA, 22 nt, Artificial Sequence
  Synthetic
acaguaaugggaauaaccacug

SEQ ID NO: 18435 - RNA, 23 nt, Artificial Sequence
  Synthetic
gacaguaaugggaauaaccacug

SEQ ID NO: 18436 - RNA, 24 nt, Artificial Sequence
  Synthetic
ugacaguaaugggaauaaccacug

SEQ ID NO: 18437 - RNA, 18 nt, Artificial Sequence
  Synthetic
aguuuuaauuggaugcug

SEQ ID NO: 18438 - RNA, 19 nt, Artificial Sequence
  Synthetic
aaguuuuaauuggaugcug

SEQ ID NO: 18439 - RNA, 21 nt, Artificial Sequence
  Synthetic
cuaaguuuuaauuggaugcug

SEQ ID NO: 18440 - RNA, 22 nt, Artificial Sequence
  Synthetic
ucuaaguuuuaauuggaugcug

SEQ ID NO: 18441 - RNA, 23 nt, Artificial Sequence
  Synthetic
aucuaaguuuuaauuggaugcug

SEQ ID NO: 18442 - RNA, 24 nt, Artificial Sequence
  Synthetic
uaucuaaguuuuaauuggaugcug

SEQ ID NO: 18443 - RNA, 18 nt, Artificial Sequence
  Synthetic
aaaccuguagcauugcug

SEQ ID NO: 18444 - RNA, 19 nt, Artificial Sequence
  Synthetic
gaaaccuguagcauugcug

SEQ ID NO: 18445 - RNA, 20 nt, Artificial Sequence
  Synthetic
agaaaccuguagcauugcug

SEQ ID NO: 18446 - RNA, 21 nt, Artificial Sequence
  Synthetic
uagaaaccuguagcauugcug

SEQ ID NO: 18447 - RNA, 22 nt, Artificial Sequence
  Synthetic
auagaaaccuguagcauugcug

SEQ ID NO: 18448 - RNA, 23 nt, Artificial Sequence
  Synthetic
cauagaaaccuguagcauugcug

SEQ ID NO: 18449 - RNA, 24 nt, Artificial Sequence
  Synthetic
acauagaaaccuguagcauugcug

SEQ ID NO: 18450 - RNA, 18 nt, Artificial Sequence
  Synthetic
ccuuggccucccaaagug

SEQ ID NO: 18451 - RNA, 19 nt, Artificial Sequence
  Synthetic
gccuuggccucccaaagug

SEQ ID NO: 18452 - RNA, 20 nt, Artificial Sequence
  Synthetic
cgccuuggccucccaaagug

SEQ ID NO: 18453 - RNA, 21 nt, Artificial Sequence
  Synthetic
ccgccuuggccucccaaagug

SEQ ID NO: 18454 - RNA, 22 nt, Artificial Sequence
  Synthetic
cccgccuuggccucccaaagug

SEQ ID NO: 18455 - RNA, 23 nt, Artificial Sequence
  Synthetic
gcccgccuuggccucccaaagug

SEQ ID NO: 18456 - RNA, 24 nt, Artificial Sequence
  Synthetic
ugcccgccuuggccucccaaagug

SEQ ID NO: 18457 - RNA, 18 nt, Artificial Sequence
  Synthetic
cagauaaaagggugagug

SEQ ID NO: 18458 - RNA, 19 nt, Artificial Sequence
  Synthetic
ccagauaaaagggugagug

SEQ ID NO: 18459 - RNA, 20 nt, Artificial Sequence
  Synthetic
gccagauaaaagggugagug

SEQ ID NO: 18460 - RNA, 21 nt, Artificial Sequence
  Synthetic
ugccagauaaaagggugagug

SEQ ID NO: 18461 - RNA, 22 nt, Artificial Sequence
  Synthetic
augccagauaaaagggugagug

SEQ ID NO: 18462 - RNA, 23 nt, Artificial Sequence
  Synthetic
gaugccagauaaaagggugagug

SEQ ID NO: 18463 - RNA, 24 nt, Artificial Sequence
  Synthetic
ugaugccagauaaaagggugagug

SEQ ID NO: 18464 - RNA, 18 nt, Artificial Sequence
  Synthetic
gugugugagagaaaggug

SEQ ID NO: 18465 - RNA, 19 nt, Artificial Sequence
  Synthetic
ugugugugagagaaaggug

SEQ ID NO: 18466 - RNA, 20 nt, Artificial Sequence
  Synthetic
cugugugugagagaaaggug

SEQ ID NO: 18467 - RNA, 21 nt, Artificial Sequence
  Synthetic
ucugugugugagagaaaggug

SEQ ID NO: 18468 - RNA, 22 nt, Artificial Sequence
  Synthetic
cucugugugugagagaaaggug

SEQ ID NO: 18469 - RNA, 23 nt, Artificial Sequence
  Synthetic
gcucugugugugagagaaaggug

SEQ ID NO: 18470 - RNA, 24 nt, Artificial Sequence
  Synthetic
agcucugugugugagagaaaggug

SEQ ID NO: 18471 - RNA, 18 nt, Artificial Sequence
  Synthetic
uaugugaagaccuaggug

SEQ ID NO: 18472 - RNA, 19 nt, Artificial Sequence
  Synthetic
cuaugugaagaccuaggug

SEQ ID NO: 18473 - RNA, 20 nt, Artificial Sequence
  Synthetic
acuaugugaagaccuaggug

SEQ ID NO: 18474 - RNA, 21 nt, Artificial Sequence
  Synthetic
aacuaugugaagaccuaggug

SEQ ID NO: 18475 - RNA, 22 nt, Artificial Sequence
  Synthetic
gaacuaugugaagaccuaggug

SEQ ID NO: 18476 - RNA, 23 nt, Artificial Sequence
  Synthetic
ugaacuaugugaagaccuaggug

SEQ ID NO: 18477 - RNA, 24 nt, Artificial Sequence
  Synthetic
cugaacuaugugaagaccuaggug

SEQ ID NO: 18478 - RNA, 18 nt, Artificial Sequence
  Synthetic
aagguggagaagcaugug

SEQ ID NO: 18479 - RNA, 19 nt, Artificial Sequence
  Synthetic
aaagguggagaagcaugug

SEQ ID NO: 18480 - RNA, 21 nt, Artificial Sequence
  Synthetic
agaaagguggagaagcaugug

SEQ ID NO: 18481 - RNA, 22 nt, Artificial Sequence
  Synthetic
gagaaagguggagaagcaugug

SEQ ID NO: 18482 - RNA, 23 nt, Artificial Sequence
  Synthetic
agagaaagguggagaagcaugug

SEQ ID NO: 18483 - RNA, 24 nt, Artificial Sequence
  Synthetic
gagagaaagguggagaagcaugug

SEQ ID NO: 18484 - RNA, 18 nt, Artificial Sequence
  Synthetic
auauuuuauuccuuugug

SEQ ID NO: 18485 - RNA, 19 nt, Artificial Sequence
  Synthetic
gauauuuuauuccuuugug

SEQ ID NO: 18486 - RNA, 20 nt, Artificial Sequence
  Synthetic
agauauuuuauuccuuugug

SEQ ID NO: 18487 - RNA, 21 nt, Artificial Sequence
  Synthetic
gagauauuuuauuccuuugug

SEQ ID NO: 18488 - RNA, 22 nt, Artificial Sequence
  Synthetic
agagauauuuuauuccuuugug

SEQ ID NO: 18489 - RNA, 23 nt, Artificial Sequence
  Synthetic
uagagauauuuuauuccuuugug

SEQ ID NO: 18490 - RNA, 24 nt, Artificial Sequence
  Synthetic
uuagagauauuuuauuccuuugug

SEQ ID NO: 18491 - RNA, 18 nt, Artificial Sequence
  Synthetic
uagaaaccuguagcauug

SEQ ID NO: 18492 - RNA, 19 nt, Artificial Sequence
  Synthetic
auagaaaccuguagcauug

SEQ ID NO: 18493 - RNA, 20 nt, Artificial Sequence
  Synthetic
cauagaaaccuguagcauug

SEQ ID NO: 18494 - RNA, 21 nt, Artificial Sequence
  Synthetic
acauagaaaccuguagcauug

SEQ ID NO: 18495 - RNA, 22 nt, Artificial Sequence
  Synthetic
uacauagaaaccuguagcauug

SEQ ID NO: 18496 - RNA, 23 nt, Artificial Sequence
  Synthetic
uuacauagaaaccuguagcauug

SEQ ID NO: 18497 - RNA, 24 nt, Artificial Sequence
  Synthetic
auuacauagaaaccuguagcauug

SEQ ID NO: 18498 - RNA, 18 nt, Artificial Sequence
  Synthetic
gugguugccagaugguug

SEQ ID NO: 18499 - RNA, 19 nt, Artificial Sequence
  Synthetic
agugguugccagaugguug

SEQ ID NO: 18500 - RNA, 20 nt, Artificial Sequence
  Synthetic
aagugguugccagaugguug

SEQ ID NO: 18501 - RNA, 21 nt, Artificial Sequence
  Synthetic
caagugguugccagaugguug

SEQ ID NO: 18502 - RNA, 22 nt, Artificial Sequence
  Synthetic
ucaagugguugccagaugguug

SEQ ID NO: 18503 - RNA, 23 nt, Artificial Sequence
  Synthetic
cucaagugguugccagaugguug

SEQ ID NO: 18504 - RNA, 24 nt, Artificial Sequence
  Synthetic
ccucaagugguugccagaugguug

SEQ ID NO: 18505 - RNA, 18 nt, Artificial Sequence
  Synthetic
ugauccauuucuccuuug

SEQ ID NO: 18506 - RNA, 19 nt, Artificial Sequence
  Synthetic
cugauccauuucuccuuug

SEQ ID NO: 18507 - RNA, 20 nt, Artificial Sequence
  Synthetic
ucugauccauuucuccuuug

SEQ ID NO: 18508 - RNA, 21 nt, Artificial Sequence
  Synthetic
aucugauccauuucuccuuug

SEQ ID NO: 18509 - RNA, 22 nt, Artificial Sequence
  Synthetic
caucugauccauuucuccuuug

SEQ ID NO: 18510 - RNA, 23 nt, Artificial Sequence
  Synthetic
ccaucugauccauuucuccuuug

SEQ ID NO: 18511 - RNA, 24 nt, Artificial Sequence
  Synthetic
cccaucugauccauuucuccuuug

SEQ ID NO: 18512 - RNA, 18 nt, Artificial Sequence
  Synthetic
aggccuggcuaauuuuug

SEQ ID NO: 18513 - RNA, 19 nt, Artificial Sequence
  Synthetic
caggccuggcuaauuuuug

SEQ ID NO: 18514 - RNA, 20 nt, Artificial Sequence
  Synthetic
ccaggccuggcuaauuuuug

SEQ ID NO: 18515 - RNA, 21 nt, Artificial Sequence
  Synthetic
accaggccuggcuaauuuuug

SEQ ID NO: 18516 - RNA, 22 nt, Artificial Sequence
  Synthetic
caccaggccuggcuaauuuuug

SEQ ID NO: 18517 - RNA, 23 nt, Artificial Sequence
  Synthetic
ccaccaggccuggcuaauuuuug

SEQ ID NO: 18518 - RNA, 24 nt, Artificial Sequence
  Synthetic
accaccaggccuggcuaauuuuug

SEQ ID NO: 18519 - RNA, 18 nt, Artificial Sequence
  Synthetic
cuuuguccuuggcuaaau

SEQ ID NO: 18520 - RNA, 19 nt, Artificial Sequence
  Synthetic
ccuuuguccuuggcuaaau

SEQ ID NO: 18521 - RNA, 20 nt, Artificial Sequence
  Synthetic
cccuuuguccuuggcuaaau

SEQ ID NO: 18522 - RNA, 21 nt, Artificial Sequence
  Synthetic
gcccuuuguccuuggcuaaau

SEQ ID NO: 18523 - RNA, 22 nt, Artificial Sequence
  Synthetic
agcccuuuguccuuggcuaaau

SEQ ID NO: 18524 - RNA, 23 nt, Artificial Sequence
  Synthetic
gagcccuuuguccuuggcuaaau

SEQ ID NO: 18525 - RNA, 24 nt, Artificial Sequence
  Synthetic
ggagcccuuuguccuuggcuaaau

SEQ ID NO: 18526 - RNA, 18 nt, Artificial Sequence
  Synthetic
augaauccaugauggaau

SEQ ID NO: 18527 - RNA, 19 nt, Artificial Sequence
  Synthetic
aaugaauccaugauggaau

SEQ ID NO: 18528 - RNA, 20 nt, Artificial Sequence
  Synthetic
gaaugaauccaugauggaau

SEQ ID NO: 18529 - RNA, 21 nt, Artificial Sequence
  Synthetic
ugaaugaauccaugauggaau

SEQ ID NO: 18530 - RNA, 22 nt, Artificial Sequence
  Synthetic
uugaaugaauccaugauggaau

SEQ ID NO: 18531 - RNA, 23 nt, Artificial Sequence
  Synthetic
guugaaugaauccaugauggaau

SEQ ID NO: 18532 - RNA, 24 nt, Artificial Sequence
  Synthetic
uguugaaugaauccaugauggaau

SEQ ID NO: 18533 - RNA, 18 nt, Artificial Sequence
  Synthetic
agaaagguggagaagcau

SEQ ID NO: 18534 - RNA, 19 nt, Artificial Sequence
  Synthetic
gagaaagguggagaagcau

SEQ ID NO: 18535 - RNA, 20 nt, Artificial Sequence
  Synthetic
agagaaagguggagaagcau

SEQ ID NO: 18536 - RNA, 21 nt, Artificial Sequence
  Synthetic
gagagaaagguggagaagcau

SEQ ID NO: 18537 - RNA, 22 nt, Artificial Sequence
  Synthetic
ugagagaaagguggagaagcau

SEQ ID NO: 18538 - RNA, 23 nt, Artificial Sequence
  Synthetic
gugagagaaagguggagaagcau

SEQ ID NO: 18539 - RNA, 24 nt, Artificial Sequence
  Synthetic
ugugagagaaagguggagaagcau

SEQ ID NO: 18540 - RNA, 18 nt, Artificial Sequence
  Synthetic
guggggagggaaauagau

SEQ ID NO: 18541 - RNA, 19 nt, Artificial Sequence
  Synthetic
uguggggagggaaauagau

SEQ ID NO: 18542 - RNA, 21 nt, Artificial Sequence
  Synthetic
cauguggggagggaaauagau

SEQ ID NO: 18543 - RNA, 22 nt, Artificial Sequence
  Synthetic
gcauguggggagggaaauagau

SEQ ID NO: 18544 - RNA, 23 nt, Artificial Sequence
  Synthetic
agcauguggggagggaaauagau

SEQ ID NO: 18545 - RNA, 24 nt, Artificial Sequence
  Synthetic
aagcauguggggagggaaauagau

SEQ ID NO: 18546 - RNA, 18 nt, Artificial Sequence
  Synthetic
uuuuguauuuuaguagau

SEQ ID NO: 18547 - RNA, 19 nt, Artificial Sequence
  Synthetic
uuuuuguauuuuaguagau

SEQ ID NO: 18548 - RNA, 20 nt, Artificial Sequence
  Synthetic
auuuuuguauuuuaguagau

SEQ ID NO: 18549 - RNA, 21 nt, Artificial Sequence
  Synthetic
aauuuuuguauuuuaguagau

SEQ ID NO: 18550 - RNA, 22 nt, Artificial Sequence
  Synthetic
uaauuuuuguauuuuaguagau

SEQ ID NO: 18551 - RNA, 23 nt, Artificial Sequence
  Synthetic
cuaauuuuuguauuuuaguagau

SEQ ID NO: 18552 - RNA, 24 nt, Artificial Sequence
  Synthetic
gcuaauuuuuguauuuuaguagau

SEQ ID NO: 18553 - RNA, 18 nt, Artificial Sequence
  Synthetic
caagauuguagucaggau

SEQ ID NO: 18554 - RNA, 19 nt, Artificial Sequence
  Synthetic
ccaagauuguagucaggau

SEQ ID NO: 18555 - RNA, 20 nt, Artificial Sequence
  Synthetic
uccaagauuguagucaggau

SEQ ID NO: 18556 - RNA, 21 nt, Artificial Sequence
  Synthetic
uuccaagauuguagucaggau

SEQ ID NO: 18557 - RNA, 22 nt, Artificial Sequence
  Synthetic
guuccaagauuguagucaggau

SEQ ID NO: 18558 - RNA, 23 nt, Artificial Sequence
  Synthetic
cguuccaagauuguagucaggau

SEQ ID NO: 18559 - RNA, 24 nt, Artificial Sequence
  Synthetic
ccguuccaagauuguagucaggau

SEQ ID NO: 18560 - RNA, 18 nt, Artificial Sequence
  Synthetic
uaaccaaauguuauggau

SEQ ID NO: 18561 - RNA, 19 nt, Artificial Sequence
  Synthetic
guaaccaaauguuauggau

SEQ ID NO: 18562 - RNA, 21 nt, Artificial Sequence
  Synthetic
gaguaaccaaauguuauggau

SEQ ID NO: 18563 - RNA, 22 nt, Artificial Sequence
  Synthetic
ugaguaaccaaauguuauggau

SEQ ID NO: 18564 - RNA, 23 nt, Artificial Sequence
  Synthetic
cugaguaaccaaauguuauggau

SEQ ID NO: 18565 - RNA, 24 nt, Artificial Sequence
  Synthetic
ucugaguaaccaaauguuauggau

SEQ ID NO: 18566 - RNA, 18 nt, Artificial Sequence
  Synthetic
aacuucuucccuucugau

SEQ ID NO: 18567 - RNA, 19 nt, Artificial Sequence
  Synthetic
aaacuucuucccuucugau

SEQ ID NO: 18568 - RNA, 20 nt, Artificial Sequence
  Synthetic
aaaacuucuucccuucugau

SEQ ID NO: 18569 - RNA, 21 nt, Artificial Sequence
  Synthetic
uaaaacuucuucccuucugau

SEQ ID NO: 18570 - RNA, 22 nt, Artificial Sequence
  Synthetic
auaaaacuucuucccuucugau

SEQ ID NO: 18571 - RNA, 23 nt, Artificial Sequence
  Synthetic
aauaaaacuucuucccuucugau

SEQ ID NO: 18572 - RNA, 24 nt, Artificial Sequence
  Synthetic
gaauaaaacuucuucccuucugau

SEQ ID NO: 18573 - RNA, 18 nt, Artificial Sequence
  Synthetic
ucaugaagccugaacuau

SEQ ID NO: 18574 - RNA, 19 nt, Artificial Sequence
  Synthetic
cucaugaagccugaacuau

SEQ ID NO: 18575 - RNA, 20 nt, Artificial Sequence
  Synthetic
gcucaugaagccugaacuau

SEQ ID NO: 18576 - RNA, 21 nt, Artificial Sequence
  Synthetic
ggcucaugaagccugaacuau

SEQ ID NO: 18577 - RNA, 22 nt, Artificial Sequence
  Synthetic
uggcucaugaagccugaacuau

SEQ ID NO: 18578 - RNA, 23 nt, Artificial Sequence
  Synthetic
uuggcucaugaagccugaacuau

SEQ ID NO: 18579 - RNA, 24 nt, Artificial Sequence
  Synthetic
auuggcucaugaagccugaacuau

SEQ ID NO: 18580 - RNA, 18 nt, Artificial Sequence
  Synthetic
uucuuauaaaauugguau

SEQ ID NO: 18581 - RNA, 19 nt, Artificial Sequence
  Synthetic
uuucuuauaaaauugguau

SEQ ID NO: 18582 - RNA, 20 nt, Artificial Sequence
  Synthetic
uuuucuuauaaaauugguau

SEQ ID NO: 18583 - RNA, 21 nt, Artificial Sequence
  Synthetic
cuuuucuuauaaaauugguau

SEQ ID NO: 18584 - RNA, 22 nt, Artificial Sequence
  Synthetic
ucuuuucuuauaaaauugguau

SEQ ID NO: 18585 - RNA, 23 nt, Artificial Sequence
  Synthetic
uucuuuucuuauaaaauugguau

SEQ ID NO: 18586 - RNA, 24 nt, Artificial Sequence
  Synthetic
cuucuuuucuuauaaaauugguau

SEQ ID NO: 18587 - RNA, 18 nt, Artificial Sequence
  Synthetic
ucagagaauuugucuuau

SEQ ID NO: 18588 - RNA, 19 nt, Artificial Sequence
  Synthetic
uucagagaauuugucuuau

SEQ ID NO: 18589 - RNA, 20 nt, Artificial Sequence
  Synthetic
uuucagagaauuugucuuau

SEQ ID NO: 18590 - RNA, 21 nt, Artificial Sequence
  Synthetic
guuucagagaauuugucuuau

SEQ ID NO: 18591 - RNA, 22 nt, Artificial Sequence
  Synthetic
gguuucagagaauuugucuuau

SEQ ID NO: 18592 - RNA, 23 nt, Artificial Sequence
  Synthetic
ugguuucagagaauuugucuuau

SEQ ID NO: 18593 - RNA, 24 nt, Artificial Sequence
  Synthetic
uugguuucagagaauuugucuuau

SEQ ID NO: 18594 - RNA, 18 nt, Artificial Sequence
  Synthetic
uuuguaccucugcacccu

SEQ ID NO: 18595 - RNA, 19 nt, Artificial Sequence
  Synthetic
cuuuguaccucugcacccu

SEQ ID NO: 18596 - RNA, 21 nt, Artificial Sequence
  Synthetic
uacuuuguaccucugcacccu

SEQ ID NO: 18597 - RNA, 22 nt, Artificial Sequence
  Synthetic
guacuuuguaccucugcacccu

SEQ ID NO: 18598 - RNA, 23 nt, Artificial Sequence
  Synthetic
gguacuuuguaccucugcacccu

SEQ ID NO: 18599 - RNA, 24 nt, Artificial Sequence
  Synthetic
ugguacuuuguaccucugcacccu

SEQ ID NO: 18600 - RNA, 18 nt, Artificial Sequence
  Synthetic
aauacaaauguacucccu

SEQ ID NO: 18601 - RNA, 19 nt, Artificial Sequence
  Synthetic
gaauacaaauguacucccu

SEQ ID NO: 18602 - RNA, 21 nt, Artificial Sequence
  Synthetic
uugaauacaaauguacucccu

SEQ ID NO: 18603 - RNA, 22 nt, Artificial Sequence
  Synthetic
uuugaauacaaauguacucccu

SEQ ID NO: 18604 - RNA, 23 nt, Artificial Sequence
  Synthetic
auuugaauacaaauguacucccu

SEQ ID NO: 18605 - RNA, 24 nt, Artificial Sequence
  Synthetic
uauuugaauacaaauguacucccu

SEQ ID NO: 18606 - RNA, 18 nt, Artificial Sequence
  Synthetic
uagguggagaacuggccu

SEQ ID NO: 18607 - RNA, 19 nt, Artificial Sequence
  Synthetic
cuagguggagaacuggccu

SEQ ID NO: 18608 - RNA, 20 nt, Artificial Sequence
  Synthetic
ccuagguggagaacuggccu

SEQ ID NO: 18609 - RNA, 21 nt, Artificial Sequence
  Synthetic
accuagguggagaacuggccu

SEQ ID NO: 18610 - RNA, 22 nt, Artificial Sequence
  Synthetic
gaccuagguggagaacuggccu

SEQ ID NO: 18611 - RNA, 23 nt, Artificial Sequence
  Synthetic
agaccuagguggagaacuggccu

SEQ ID NO: 18612 - RNA, 24 nt, Artificial Sequence
  Synthetic
aagaccuagguggagaacuggccu

SEQ ID NO: 18613 - RNA, 18 nt, Artificial Sequence
  Synthetic
gaaaagcaaacugaggcu

SEQ ID NO: 18614 - RNA, 19 nt, Artificial Sequence
  Synthetic
agaaaagcaaacugaggcu

SEQ ID NO: 18615 - RNA, 20 nt, Artificial Sequence
  Synthetic
cagaaaagcaaacugaggcu

SEQ ID NO: 18616 - RNA, 21 nt, Artificial Sequence
  Synthetic
acagaaaagcaaacugaggcu

SEQ ID NO: 18617 - RNA, 22 nt, Artificial Sequence
  Synthetic
uacagaaaagcaaacugaggcu

SEQ ID NO: 18618 - RNA, 23 nt, Artificial Sequence
  Synthetic
uuacagaaaagcaaacugaggcu

SEQ ID NO: 18619 - RNA, 24 nt, Artificial Sequence
  Synthetic
uuuacagaaaagcaaacugaggcu

SEQ ID NO: 18620 - RNA, 18 nt, Artificial Sequence
  Synthetic
gaugccaagauccaugcu

SEQ ID NO: 18621 - RNA, 19 nt, Artificial Sequence
  Synthetic
ggaugccaagauccaugcu

SEQ ID NO: 18622 - RNA, 20 nt, Artificial Sequence
  Synthetic
gggaugccaagauccaugcu

SEQ ID NO: 18623 - RNA, 21 nt, Artificial Sequence
  Synthetic
ggggaugccaagauccaugcu

SEQ ID NO: 18624 - RNA, 22 nt, Artificial Sequence
  Synthetic
aggggaugccaagauccaugcu

SEQ ID NO: 18625 - RNA, 23 nt, Artificial Sequence
  Synthetic
uaggggaugccaagauccaugcu

SEQ ID NO: 18626 - RNA, 24 nt, Artificial Sequence
  Synthetic
cuaggggaugccaagauccaugcu

SEQ ID NO: 18627 - RNA, 18 nt, Artificial Sequence
  Synthetic
aaguuuuaauuggaugcu

SEQ ID NO: 18628 - RNA, 19 nt, Artificial Sequence
  Synthetic
uaaguuuuaauuggaugcu

SEQ ID NO: 18629 - RNA, 20 nt, Artificial Sequence
  Synthetic
cuaaguuuuaauuggaugcu

SEQ ID NO: 18630 - RNA, 21 nt, Artificial Sequence
  Synthetic
ucuaaguuuuaauuggaugcu

SEQ ID NO: 18631 - RNA, 22 nt, Artificial Sequence
  Synthetic
aucuaaguuuuaauuggaugcu

SEQ ID NO: 18632 - RNA, 23 nt, Artificial Sequence
  Synthetic
uaucuaaguuuuaauuggaugcu

SEQ ID NO: 18633 - RNA, 24 nt, Artificial Sequence
  Synthetic
auaucuaaguuuuaauuggaugcu

SEQ ID NO: 18634 - RNA, 18 nt, Artificial Sequence
  Synthetic
ucucauuagcaagcuucu

SEQ ID NO: 18635 - RNA, 19 nt, Artificial Sequence
  Synthetic
cucucauuagcaagcuucu

SEQ ID NO: 18636 - RNA, 21 nt, Artificial Sequence
  Synthetic
ggcucucauuagcaagcuucu

SEQ ID NO: 18637 - RNA, 22 nt, Artificial Sequence
  Synthetic
gggcucucauuagcaagcuucu

SEQ ID NO: 18638 - RNA, 23 nt, Artificial Sequence
  Synthetic
agggcucucauuagcaagcuucu

SEQ ID NO: 18639 - RNA, 24 nt, Artificial Sequence
  Synthetic
aagggcucucauuagcaagcuucu

SEQ ID NO: 18640 - RNA, 18 nt, Artificial Sequence
  Synthetic
uuuucaucucuguacagu

SEQ ID NO: 18641 - RNA, 19 nt, Artificial Sequence
  Synthetic
uuuuucaucucuguacagu

SEQ ID NO: 18642 - RNA, 20 nt, Artificial Sequence
  Synthetic
auuuuucaucucuguacagu

SEQ ID NO: 18643 - RNA, 21 nt, Artificial Sequence
  Synthetic
aauuuuucaucucuguacagu

SEQ ID NO: 18644 - RNA, 22 nt, Artificial Sequence
  Synthetic
aaauuuuucaucucuguacagu

SEQ ID NO: 18645 - RNA, 23 nt, Artificial Sequence
  Synthetic
gaaauuuuucaucucuguacagu

SEQ ID NO: 18646 - RNA, 24 nt, Artificial Sequence
  Synthetic
ugaaauuuuucaucucuguacagu

SEQ ID NO: 18647 - RNA, 18 nt, Artificial Sequence
  Synthetic
uuucuacauuacuuccgu

SEQ ID NO: 18648 - RNA, 19 nt, Artificial Sequence
  Synthetic
cuuucuacauuacuuccgu

SEQ ID NO: 18649 - RNA, 20 nt, Artificial Sequence
  Synthetic
ccuuucuacauuacuuccgu

SEQ ID NO: 18650 - RNA, 21 nt, Artificial Sequence
  Synthetic
accuuucuacauuacuuccgu

SEQ ID NO: 18651 - RNA, 22 nt, Artificial Sequence
  Synthetic
caccuuucuacauuacuuccgu

SEQ ID NO: 18652 - RNA, 23 nt, Artificial Sequence
  Synthetic
acaccuuucuacauuacuuccgu

SEQ ID NO: 18653 - RNA, 24 nt, Artificial Sequence
  Synthetic
aacaccuuucuacauuacuuccgu

SEQ ID NO: 18654 - RNA, 18 nt, Artificial Sequence
  Synthetic
aaugcugggauuauaggu

SEQ ID NO: 18655 - RNA, 19 nt, Artificial Sequence
  Synthetic
aaaugcugggauuauaggu

SEQ ID NO: 18656 - RNA, 20 nt, Artificial Sequence
  Synthetic
aaaaugcugggauuauaggu

SEQ ID NO: 18657 - RNA, 21 nt, Artificial Sequence
  Synthetic
caaaaugcugggauuauaggu

SEQ ID NO: 18658 - RNA, 22 nt, Artificial Sequence
  Synthetic
ccaaaaugcugggauuauaggu

SEQ ID NO: 18659 - RNA, 23 nt, Artificial Sequence
  Synthetic
cccaaaaugcugggauuauaggu

SEQ ID NO: 18660 - RNA, 24 nt, Artificial Sequence
  Synthetic
ucccaaaaugcugggauuauaggu

SEQ ID NO: 18661 - RNA, 18 nt, Artificial Sequence
  Synthetic
auaaagugggucccuggu

SEQ ID NO: 18662 - RNA, 19 nt, Artificial Sequence
  Synthetic
cauaaagugggucccuggu

SEQ ID NO: 18663 - RNA, 20 nt, Artificial Sequence
  Synthetic
acauaaagugggucccuggu

SEQ ID NO: 18664 - RNA, 21 nt, Artificial Sequence
  Synthetic
uacauaaagugggucccuggu

SEQ ID NO: 18665 - RNA, 22 nt, Artificial Sequence
  Synthetic
cuacauaaagugggucccuggu

SEQ ID NO: 18666 - RNA, 23 nt, Artificial Sequence
  Synthetic
ucuacauaaagugggucccuggu

SEQ ID NO: 18667 - RNA, 24 nt, Artificial Sequence
  Synthetic
uucuacauaaagugggucccuggu

SEQ ID NO: 18668 - RNA, 18 nt, Artificial Sequence
  Synthetic
aaagguggagaagcaugu

SEQ ID NO: 18669 - RNA, 19 nt, Artificial Sequence
  Synthetic
gaaagguggagaagcaugu

SEQ ID NO: 18670 - RNA, 21 nt, Artificial Sequence
  Synthetic
gagaaagguggagaagcaugu

SEQ ID NO: 18671 - RNA, 22 nt, Artificial Sequence
  Synthetic
agagaaagguggagaagcaugu

SEQ ID NO: 18672 - RNA, 23 nt, Artificial Sequence
  Synthetic
gagagaaagguggagaagcaugu

SEQ ID NO: 18673 - RNA, 24 nt, Artificial Sequence
  Synthetic
ugagagaaagguggagaagcaugu

SEQ ID NO: 18674 - RNA, 18 nt, Artificial Sequence
  Synthetic
gggagguuagcucugugu

SEQ ID NO: 18675 - RNA, 19 nt, Artificial Sequence
  Synthetic
ugggagguuagcucugugu

SEQ ID NO: 18676 - RNA, 20 nt, Artificial Sequence
  Synthetic
augggagguuagcucugugu

SEQ ID NO: 18677 - RNA, 21 nt, Artificial Sequence
  Synthetic
gaugggagguuagcucugugu

SEQ ID NO: 18678 - RNA, 22 nt, Artificial Sequence
  Synthetic
ggaugggagguuagcucugugu

SEQ ID NO: 18679 - RNA, 23 nt, Artificial Sequence
  Synthetic
uggaugggagguuagcucugugu

SEQ ID NO: 18680 - RNA, 24 nt, Artificial Sequence
  Synthetic
auggaugggagguuagcucugugu

SEQ ID NO: 18681 - RNA, 18 nt, Artificial Sequence
  Synthetic
gagguuagcucugugugu

SEQ ID NO: 18682 - RNA, 19 nt, Artificial Sequence
  Synthetic
ggagguuagcucugugugu

SEQ ID NO: 18683 - RNA, 20 nt, Artificial Sequence
  Synthetic
gggagguuagcucugugugu

SEQ ID NO: 18684 - RNA, 21 nt, Artificial Sequence
  Synthetic
ugggagguuagcucugugugu

SEQ ID NO: 18685 - RNA, 22 nt, Artificial Sequence
  Synthetic
augggagguuagcucugugugu

SEQ ID NO: 18686 - RNA, 23 nt, Artificial Sequence
  Synthetic
gaugggagguuagcucugugugu

SEQ ID NO: 18687 - RNA, 24 nt, Artificial Sequence
  Synthetic
ggaugggagguuagcucugugugu

SEQ ID NO: 18688 - RNA, 18 nt, Artificial Sequence
  Synthetic
aacuaaaguaacaccauu

SEQ ID NO: 18689 - RNA, 19 nt, Artificial Sequence
  Synthetic
aaacuaaaguaacaccauu

SEQ ID NO: 18690 - RNA, 20 nt, Artificial Sequence
  Synthetic
aaaacuaaaguaacaccauu

SEQ ID NO: 18691 - RNA, 21 nt, Artificial Sequence
  Synthetic
gaaaacuaaaguaacaccauu

SEQ ID NO: 18692 - RNA, 22 nt, Artificial Sequence
  Synthetic
ugaaaacuaaaguaacaccauu

SEQ ID NO: 18693 - RNA, 23 nt, Artificial Sequence
  Synthetic
gugaaaacuaaaguaacaccauu

SEQ ID NO: 18694 - RNA, 24 nt, Artificial Sequence
  Synthetic
ugugaaaacuaaaguaacaccauu

SEQ ID NO: 18695 - RNA, 18 nt, Artificial Sequence
  Synthetic
uuuccuuuuuuuggcauu

SEQ ID NO: 18696 - RNA, 19 nt, Artificial Sequence
  Synthetic
auuuccuuuuuuuggcauu

SEQ ID NO: 18697 - RNA, 20 nt, Artificial Sequence
  Synthetic
cauuuccuuuuuuuggcauu

SEQ ID NO: 18698 - RNA, 21 nt, Artificial Sequence
  Synthetic
ucauuuccuuuuuuuggcauu

SEQ ID NO: 18699 - RNA, 22 nt, Artificial Sequence
  Synthetic
uucauuuccuuuuuuuggcauu

SEQ ID NO: 18700 - RNA, 23 nt, Artificial Sequence
  Synthetic
auucauuuccuuuuuuuggcauu

SEQ ID NO: 18701 - RNA, 24 nt, Artificial Sequence
  Synthetic
aauucauuuccuuuuuuuggcauu

SEQ ID NO: 18702 - RNA, 18 nt, Artificial Sequence
  Synthetic
uacuccuuuagagugauu

SEQ ID NO: 18703 - RNA, 19 nt, Artificial Sequence
  Synthetic
uuacuccuuuagagugauu

SEQ ID NO: 18704 - RNA, 20 nt, Artificial Sequence
  Synthetic
auuacuccuuuagagugauu

SEQ ID NO: 18705 - RNA, 21 nt, Artificial Sequence
  Synthetic
uauuacuccuuuagagugauu

SEQ ID NO: 18706 - RNA, 22 nt, Artificial Sequence
  Synthetic
cuauuacuccuuuagagugauu

SEQ ID NO: 18707 - RNA, 23 nt, Artificial Sequence
  Synthetic
ccuauuacuccuuuagagugauu

SEQ ID NO: 18708 - RNA, 24 nt, Artificial Sequence
  Synthetic
gccuauuacuccuuuagagugauu

SEQ ID NO: 18709 - RNA, 18 nt, Artificial Sequence
  Synthetic
gaaauuuauugaaauauu

SEQ ID NO: 18710 - RNA, 19 nt, Artificial Sequence
  Synthetic
ugaaauuuauugaaauauu

SEQ ID NO: 18711 - RNA, 20 nt, Artificial Sequence
  Synthetic
uugaaauuuauugaaauauu

SEQ ID NO: 18712 - RNA, 21 nt, Artificial Sequence
  Synthetic
uuugaaauuuauugaaauauu

SEQ ID NO: 18713 - RNA, 22 nt, Artificial Sequence
  Synthetic
auuugaaauuuauugaaauauu

SEQ ID NO: 18714 - RNA, 23 nt, Artificial Sequence
  Synthetic
uauuugaaauuuauugaaauauu

SEQ ID NO: 18715 - RNA, 24 nt, Artificial Sequence
  Synthetic
guauuugaaauuuauugaaauauu

SEQ ID NO: 18716 - RNA, 18 nt, Artificial Sequence
  Synthetic
aauuaagaugauaauauu

SEQ ID NO: 18717 - RNA, 19 nt, Artificial Sequence
  Synthetic
aaauuaagaugauaauauu

SEQ ID NO: 18718 - RNA, 20 nt, Artificial Sequence
  Synthetic
aaaauuaagaugauaauauu

SEQ ID NO: 18719 - RNA, 21 nt, Artificial Sequence
  Synthetic
gaaaauuaagaugauaauauu

SEQ ID NO: 18720 - RNA, 22 nt, Artificial Sequence
  Synthetic
ugaaaauuaagaugauaauauu

SEQ ID NO: 18721 - RNA, 23 nt, Artificial Sequence
  Synthetic
uugaaaauuaagaugauaauauu

SEQ ID NO: 18722 - RNA, 24 nt, Artificial Sequence
  Synthetic
uuugaaaauuaagaugauaauauu

SEQ ID NO: 18723 - RNA, 18 nt, Artificial Sequence
  Synthetic
uuguaccucugcacccuu

SEQ ID NO: 18724 - RNA, 19 nt, Artificial Sequence
  Synthetic
uuuguaccucugcacccuu

SEQ ID NO: 18725 - RNA, 21 nt, Artificial Sequence
  Synthetic
acuuuguaccucugcacccuu

SEQ ID NO: 18726 - RNA, 22 nt, Artificial Sequence
  Synthetic
uacuuuguaccucugcacccuu

SEQ ID NO: 18727 - RNA, 23 nt, Artificial Sequence
  Synthetic
guacuuuguaccucugcacccuu

SEQ ID NO: 18728 - RNA, 24 nt, Artificial Sequence
  Synthetic
gguacuuuguaccucugcacccuu

SEQ ID NO: 18729 - RNA, 18 nt, Artificial Sequence
  Synthetic
agguggagaacuggccuu

SEQ ID NO: 18730 - RNA, 19 nt, Artificial Sequence
  Synthetic
uagguggagaacuggccuu

SEQ ID NO: 18731 - RNA, 21 nt, Artificial Sequence
  Synthetic
ccuagguggagaacuggccuu

SEQ ID NO: 18732 - RNA, 22 nt, Artificial Sequence
  Synthetic
accuagguggagaacuggccuu

SEQ ID NO: 18733 - RNA, 23 nt, Artificial Sequence
  Synthetic
gaccuagguggagaacuggccuu

SEQ ID NO: 18734 - RNA, 24 nt, Artificial Sequence
  Synthetic
agaccuagguggagaacuggccuu

SEQ ID NO: 18735 - RNA, 18 nt, Artificial Sequence
  Synthetic
ggucacuagagaccucuu

SEQ ID NO: 18736 - RNA, 19 nt, Artificial Sequence
  Synthetic
gggucacuagagaccucuu

SEQ ID NO: 18737 - RNA, 20 nt, Artificial Sequence
  Synthetic
agggucacuagagaccucuu

SEQ ID NO: 18738 - RNA, 21 nt, Artificial Sequence
  Synthetic
cagggucacuagagaccucuu

SEQ ID NO: 18739 - RNA, 22 nt, Artificial Sequence
  Synthetic
ccagggucacuagagaccucuu

SEQ ID NO: 18740 - RNA, 23 nt, Artificial Sequence
  Synthetic
cccagggucacuagagaccucuu

SEQ ID NO: 18741 - RNA, 24 nt, Artificial Sequence
  Synthetic
gcccagggucacuagagaccucuu

SEQ ID NO: 18742 - RNA, 18 nt, Artificial Sequence
  Synthetic
aaauuuauugaaauauuu

SEQ ID NO: 18743 - RNA, 19 nt, Artificial Sequence
  Synthetic
gaaauuuauugaaauauuu

SEQ ID NO: 18744 - RNA, 21 nt, Artificial Sequence
  Synthetic
uugaaauuuauugaaauauuu

SEQ ID NO: 18745 - RNA, 22 nt, Artificial Sequence
  Synthetic
uuugaaauuuauugaaauauuu

SEQ ID NO: 18746 - RNA, 23 nt, Artificial Sequence
  Synthetic
auuugaaauuuauugaaauauuu

SEQ ID NO: 18747 - RNA, 24 nt, Artificial Sequence
  Synthetic
uauuugaaauuuauugaaauauuu

SEQ ID NO: 18748 - RNA, 18 nt, Artificial Sequence
  Synthetic
gagauauuuuauuccuuu

SEQ ID NO: 18749 - RNA, 19 nt, Artificial Sequence
  Synthetic
agagauauuuuauuccuuu

SEQ ID NO: 18750 - RNA, 20 nt, Artificial Sequence
  Synthetic
uagagauauuuuauuccuuu

SEQ ID NO: 18751 - RNA, 21 nt, Artificial Sequence
  Synthetic
uuagagauauuuuauuccuuu

SEQ ID NO: 18752 - RNA, 22 nt, Artificial Sequence
  Synthetic
uuuagagauauuuuauuccuuu

SEQ ID NO: 18753 - RNA, 23 nt, Artificial Sequence
  Synthetic
auuuagagauauuuuauuccuuu

SEQ ID NO: 18754 - RNA, 24 nt, Artificial Sequence
  Synthetic
uauuuagagauauuuuauuccuuu

SEQ ID NO: 18755 - RNA, 18 nt, Artificial Sequence
  Synthetic
cucuuugcuccuaucuuu

SEQ ID NO: 18756 - RNA, 19 nt, Artificial Sequence
  Synthetic
acucuuugcuccuaucuuu

SEQ ID NO: 18757 - RNA, 20 nt, Artificial Sequence
  Synthetic
aacucuuugcuccuaucuuu

SEQ ID NO: 18758 - RNA, 21 nt, Artificial Sequence
  Synthetic
gaacucuuugcuccuaucuuu

SEQ ID NO: 18759 - RNA, 22 nt, Artificial Sequence
  Synthetic
agaacucuuugcuccuaucuuu

SEQ ID NO: 18760 - RNA, 23 nt, Artificial Sequence
  Synthetic
uagaacucuuugcuccuaucuuu

SEQ ID NO: 18761 - RNA, 24 nt, Artificial Sequence
  Synthetic
uuagaacucuuugcuccuaucuuu

SEQ ID NO: 18762 - RNA, 18 nt, Artificial Sequence
  Synthetic
aaaauacacauuugguuu

SEQ ID NO: 18763 - RNA, 19 nt, Artificial Sequence
  Synthetic
aaaaauacacauuugguuu

SEQ ID NO: 18764 - RNA, 20 nt, Artificial Sequence
  Synthetic
gaaaaauacacauuugguuu

SEQ ID NO: 18765 - RNA, 21 nt, Artificial Sequence
  Synthetic
ugaaaaauacacauuugguuu

SEQ ID NO: 18766 - RNA, 22 nt, Artificial Sequence
  Synthetic
cugaaaaauacacauuugguuu

SEQ ID NO: 18767 - RNA, 23 nt, Artificial Sequence
  Synthetic
ccugaaaaauacacauuugguuu

SEQ ID NO: 18768 - RNA, 24 nt, Artificial Sequence
  Synthetic
uccugaaaaauacacauuugguuu

SEQ ID NO: 18769 - RNA, 18 nt, Artificial Sequence
  Synthetic
uuguuguugcuguuguuu

SEQ ID NO: 18770 - RNA, 19 nt, Artificial Sequence
  Synthetic
guuguuguugcuguuguuu

SEQ ID NO: 18771 - RNA, 20 nt, Artificial Sequence
  Synthetic
uguuguuguugcuguuguuu

SEQ ID NO: 18772 - RNA, 21 nt, Artificial Sequence
  Synthetic
uuguuguuguugcuguuguuu

SEQ ID NO: 18773 - RNA, 22 nt, Artificial Sequence
  Synthetic
guuguuguuguugcuguuguuu

SEQ ID NO: 18774 - RNA, 23 nt, Artificial Sequence
  Synthetic
uguuguuguuguugcuguuguuu

SEQ ID NO: 18775 - RNA, 24 nt, Artificial Sequence
  Synthetic
uuguuguuguuguugcuguuguuu

SEQ ID NO: 18776 - RNA, 18 nt, Artificial Sequence
  Synthetic
uguuuguguuguuuguuu

SEQ ID NO: 18777 - RNA, 19 nt, Artificial Sequence
  Synthetic
uuguuuguguuguuuguuu

SEQ ID NO: 18778 - RNA, 20 nt, Artificial Sequence
  Synthetic
uuuguuuguguuguuuguuu

SEQ ID NO: 18779 - RNA, 21 nt, Artificial Sequence
  Synthetic
guuuguuuguguuguuuguuu

SEQ ID NO: 18780 - RNA, 22 nt, Artificial Sequence
  Synthetic
uguuuguuuguguuguuuguuu

SEQ ID NO: 18781 - RNA, 23 nt, Artificial Sequence
  Synthetic
uuguuuguuuguguuguuuguuu

SEQ ID NO: 18782 - RNA, 24 nt, Artificial Sequence
  Synthetic
uuuguuuguuuguguuguuuguuu

SEQ ID NO: 18783 - RNA, 18 nt, Artificial Sequence
  Synthetic
gaccaugagauggauuuu

SEQ ID NO: 18784 - RNA, 19 nt, Artificial Sequence
  Synthetic
agaccaugagauggauuuu

SEQ ID NO: 18785 - RNA, 20 nt, Artificial Sequence
  Synthetic
gagaccaugagauggauuuu

SEQ ID NO: 18786 - RNA, 21 nt, Artificial Sequence
  Synthetic
agagaccaugagauggauuuu

SEQ ID NO: 18787 - RNA, 22 nt, Artificial Sequence
  Synthetic
uagagaccaugagauggauuuu

SEQ ID NO: 18788 - RNA, 23 nt, Artificial Sequence
  Synthetic
uuagagaccaugagauggauuuu

SEQ ID NO: 18789 - RNA, 24 nt, Artificial Sequence
  Synthetic
auuagagaccaugagauggauuuu

SEQ ID NO: 18790 - RNA, 17 nt, Artificial Sequence
  Synthetic
ggugagucugcuccaua

SEQ ID NO: 18791 - RNA, 17 nt, Artificial Sequence
  Synthetic
ggccuauuacuccuuua

SEQ ID NO: 18792 - RNA, 17 nt, Artificial Sequence
  Synthetic
gugaaucugcuacuccc

SEQ ID NO: 18793 - RNA, 17 nt, Artificial Sequence
  Synthetic
guuuugaaagcaaauau

SEQ ID NO: 18794 - RNA, 17 nt, Artificial Sequence
  Synthetic
ggaucuuggcauccccu

SEQ ID NO: 18795 - RNA, 17 nt, Artificial Sequence
  Synthetic
gcacacugcaguuaugu

SEQ ID NO: 18796 - RNA, 20 nt, Artificial Sequence
  Synthetic
gaaggugagucugcuccaua

SEQ ID NO: 18797 - RNA, 20 nt, Artificial Sequence
  Synthetic
gaacuugucaauauaccugc

SEQ ID NO: 18798 - RNA, 20 nt, Artificial Sequence
  Synthetic
guuuauguacacaccccuuc

SEQ ID NO: 18799 - RNA, 20 nt, Artificial Sequence
  Synthetic
guuuuaauuggaugcugagg

SEQ ID NO: 18800 - RNA, 20 nt, Artificial Sequence
  Synthetic
guuuuauuuucucagaccgg

SEQ ID NO: 18801 - RNA, 20 nt, Artificial Sequence
  Synthetic
gugcaaaccacacauccguu

SEQ ID NO: 18802 - RNA, 17 nt, Artificial Sequence
  Synthetic
uagaugggaaaagguaa

SEQ ID NO: 18803 - RNA, 17 nt, Artificial Sequence
  Synthetic
cuuauuagagaccauga

SEQ ID NO: 18804 - RNA, 17 nt, Artificial Sequence
  Synthetic
caauuaacccagcccua

SEQ ID NO: 18805 - RNA, 17 nt, Artificial Sequence
  Synthetic
cugaauuugcagaauua

SEQ ID NO: 18806 - RNA, 17 nt, Artificial Sequence
  Synthetic
uagguaaacaauuagac

SEQ ID NO: 18807 - RNA, 17 nt, Artificial Sequence
  Synthetic
cacccuugggaagugac

SEQ ID NO: 18808 - RNA, 17 nt, Artificial Sequence
  Synthetic
uggcucaauuuugugac

SEQ ID NO: 18809 - RNA, 17 nt, Artificial Sequence
  Synthetic
ucaaaaggauccuaacc

SEQ ID NO: 18810 - RNA, 17 nt, Artificial Sequence
  Synthetic
aauacuauaggaacacc

SEQ ID NO: 18811 - RNA, 17 nt, Artificial Sequence
  Synthetic
caucuauuucccucccc

SEQ ID NO: 18812 - RNA, 17 nt, Artificial Sequence
  Synthetic
ucaaaagguuaggaucc

SEQ ID NO: 18813 - RNA, 17 nt, Artificial Sequence
  Synthetic
cuugucaauauaccugc

SEQ ID NO: 18814 - RNA, 17 nt, Artificial Sequence
  Synthetic
auuuauuaaguuauugc

SEQ ID NO: 18815 - RNA, 17 nt, Artificial Sequence
  Synthetic
uauguacacaccccuuc

SEQ ID NO: 18816 - RNA, 17 nt, Artificial Sequence
  Synthetic
aaaggaguaauacacag

SEQ ID NO: 18817 - RNA, 17 nt, Artificial Sequence
  Synthetic
cacuucuaagaucaagg

SEQ ID NO: 18818 - RNA, 17 nt, Artificial Sequence
  Synthetic
uuaauuggaugcugagg

SEQ ID NO: 18819 - RNA, 17 nt, Artificial Sequence
  Synthetic
uuauuuucucagaccgg

SEQ ID NO: 18820 - RNA, 17 nt, Artificial Sequence
  Synthetic
uccaugcuuagagauug

SEQ ID NO: 18821 - RNA, 17 nt, Artificial Sequence
  Synthetic
uuucaaagaccuuuaau

SEQ ID NO: 18822 - RNA, 17 nt, Artificial Sequence
  Synthetic
cuaggggaugccaagau

SEQ ID NO: 18823 - RNA, 17 nt, Artificial Sequence
  Synthetic
ugaaguaaaucguguau

SEQ ID NO: 18824 - RNA, 17 nt, Artificial Sequence
  Synthetic
ugauuggaaaggaaacu

SEQ ID NO: 18825 - RNA, 17 nt, Artificial Sequence
  Synthetic
augccaagauccaugcu

SEQ ID NO: 18826 - RNA, 17 nt, Artificial Sequence
  Synthetic
auuaagcuagugggagu

SEQ ID NO: 18827 - RNA, 17 nt, Artificial Sequence
  Synthetic
cuaggucuucacauagu

SEQ ID NO: 18828 - RNA, 17 nt, Artificial Sequence
  Synthetic
caaaccacacauccguu

SEQ ID NO: 18829 - RNA, 20 nt, Artificial Sequence
  Synthetic
aaauagaugggaaaagguaa

SEQ ID NO: 18830 - RNA, 20 nt, Artificial Sequence
  Synthetic
aguuuucacuguauccccca

SEQ ID NO: 18831 - RNA, 20 nt, Artificial Sequence
  Synthetic
ucccagagacucuugaguca

SEQ ID NO: 18832 - RNA, 20 nt, Artificial Sequence
  Synthetic
ugucuuauuagagaccauga

SEQ ID NO: 18833 - RNA, 20 nt, Artificial Sequence
  Synthetic
uuucaauuaacccagcccua

SEQ ID NO: 18834 - RNA, 20 nt, Artificial Sequence
  Synthetic
aaucugaauuugcagaauua

SEQ ID NO: 18835 - RNA, 20 nt, Artificial Sequence
  Synthetic
cccggccuauuacuccuuua

SEQ ID NO: 18836 - RNA, 20 nt, Artificial Sequence
  Synthetic
aacuagguaaacaauuagac

SEQ ID NO: 18837 - RNA, 20 nt, Artificial Sequence
  Synthetic
cugcacccuugggaagugac

SEQ ID NO: 18838 - RNA, 20 nt, Artificial Sequence
  Synthetic
aucuggcucaauuuugugac

SEQ ID NO: 18839 - RNA, 20 nt, Artificial Sequence
  Synthetic
caaucaaaaggauccuaacc

SEQ ID NO: 18840 - RNA, 20 nt, Artificial Sequence
  Synthetic
uuaaauacuauaggaacacc

SEQ ID NO: 18841 - RNA, 20 nt, Artificial Sequence
  Synthetic
agugugaaucugcuacuccc

SEQ ID NO: 18842 - RNA, 20 nt, Artificial Sequence
  Synthetic
caaucaaaagguuaggaucc

SEQ ID NO: 18843 - RNA, 20 nt, Artificial Sequence
  Synthetic
ucacacuucuaagaucaagg

SEQ ID NO: 18844 - RNA, 20 nt, Artificial Sequence
  Synthetic
cuagccauuucacauuccau

SEQ ID NO: 18845 - RNA, 20 nt, Artificial Sequence
  Synthetic
cuucuaggggaugccaagau

SEQ ID NO: 18846 - RNA, 20 nt, Artificial Sequence
  Synthetic
cauggaucuuggcauccccu

SEQ ID NO: 18847 - RNA, 20 nt, Artificial Sequence
  Synthetic
agaauuaagcuagugggagu

SEQ ID NO: 18848 - RNA, 20 nt, Artificial Sequence
  Synthetic
caccuaggucuucacauagu

SEQ ID NO: 18849 - RNA, 20 nt, Artificial Sequence
  Synthetic
uuugcacacugcaguuaugu

SEQ ID NO: 18850 - RNA, 20 nt, Artificial Sequence
  Synthetic
cagugacagaaacccaauuu

SEQ ID NO: 18851 - RNA, 17 nt, Artificial Sequence
  Synthetic
guuaaugaaugauggag

SEQ ID NO: 18852 - RNA, 17 nt, Artificial Sequence
  Synthetic
gccauuucacauuccau

SEQ ID NO: 18853 - RNA, 17 nt, Artificial Sequence
  Synthetic
ccagauaauucugcaaa

SEQ ID NO: 18854 - RNA, 17 nt, Artificial Sequence
  Synthetic
uccuuugugaagagaaa

SEQ ID NO: 18855 - RNA, 17 nt, Artificial Sequence
  Synthetic
cuguaaaauagagauaa

SEQ ID NO: 18856 - RNA, 17 nt, Artificial Sequence
  Synthetic
uuucacuguauccccca

SEQ ID NO: 18857 - RNA, 17 nt, Artificial Sequence
  Synthetic
uaucucucugagccuca

SEQ ID NO: 18858 - RNA, 17 nt, Artificial Sequence
  Synthetic
cagagacucuugaguca

SEQ ID NO: 18859 - RNA, 17 nt, Artificial Sequence
  Synthetic
cccagcuacucaggaga

SEQ ID NO: 18860 - RNA, 17 nt, Artificial Sequence
  Synthetic
uagaagggcucucauua

SEQ ID NO: 18861 - RNA, 17 nt, Artificial Sequence
  Synthetic
cuucgucuccuggguuc

SEQ ID NO: 18862 - RNA, 17 nt, Artificial Sequence
  Synthetic
cuacucaggagacugag

SEQ ID NO: 18863 - RNA, 17 nt, Artificial Sequence
  Synthetic
cuuggccucccaaaaug

SEQ ID NO: 18864 - RNA, 17 nt, Artificial Sequence
  Synthetic
aggugugagccacuaug

SEQ ID NO: 18865 - RNA, 17 nt, Artificial Sequence
  Synthetic
cuuggccucccaaagug

SEQ ID NO: 18866 - RNA, 17 nt, Artificial Sequence
  Synthetic
cuaugacucaagagucu

SEQ ID NO: 18867 - RNA, 17 nt, Artificial Sequence
  Synthetic
ugacagaaacccaauuu

SEQ ID NO: 18868 - RNA, 17 nt, Artificial Sequence
  Synthetic
aagaaaacagaaaguuu

SEQ ID NO: 18869 - RNA, 17 nt, Artificial Sequence
  Synthetic
auauuaaacuuuauuuu

SEQ ID NO: 18870 - RNA, 20 nt, Artificial Sequence
  Synthetic
aagccagauaauucugcaaa

SEQ ID NO: 18871 - RNA, 20 nt, Artificial Sequence
  Synthetic
uauuccuuugugaagagaaa

SEQ ID NO: 18872 - RNA, 20 nt, Artificial Sequence
  Synthetic
uuucuguaaaauagagauaa

SEQ ID NO: 18873 - RNA, 20 nt, Artificial Sequence
  Synthetic
uauuaucucucugagccuca

SEQ ID NO: 18874 - RNA, 20 nt, Artificial Sequence
  Synthetic
uuauagaagggcucucauua

SEQ ID NO: 18875 - RNA, 20 nt, Artificial Sequence
  Synthetic
ucccaucuauuucccucccc

SEQ ID NO: 18876 - RNA, 20 nt, Artificial Sequence
  Synthetic
uguauuuauuaaguuauugc

SEQ ID NO: 18877 - RNA, 20 nt, Artificial Sequence
  Synthetic
aaacuucgucuccuggguuc

SEQ ID NO: 18878 - RNA, 20 nt, Artificial Sequence
  Synthetic
ccaguuaaugaaugauggag

SEQ ID NO: 18879 - RNA, 20 nt, Artificial Sequence
  Synthetic
cagcuacucaggagacugag

SEQ ID NO: 18880 - RNA, 20 nt, Artificial Sequence
  Synthetic
uauaggugugagccacuaug

SEQ ID NO: 18881 - RNA, 20 nt, Artificial Sequence
  Synthetic
agauccaugcuuagagauug

SEQ ID NO: 18882 - RNA, 20 nt, Artificial Sequence
  Synthetic
auuuuucaaagaccuuuaau

SEQ ID NO: 18883 - RNA, 20 nt, Artificial Sequence
  Synthetic
aagguuuugaaagcaaauau

SEQ ID NO: 18884 - RNA, 20 nt, Artificial Sequence
  Synthetic
uuaugaaguaaaucguguau

SEQ ID NO: 18885 - RNA, 20 nt, Artificial Sequence
  Synthetic
uaaaagaaaacagaaaguuu

SEQ ID NO: 18886 - RNA, 20 nt, Artificial Sequence
  Synthetic
aagauauuaaacuuuauuuu

SEQ ID NO: 18887 - RNA, 17 nt, Artificial Sequence
  Synthetic
gcuuucuaguauuagaa

SEQ ID NO: 18888 - RNA, 17 nt, Artificial Sequence
  Synthetic
ggccuuuaaacauugaa

SEQ ID NO: 18889 - RNA, 17 nt, Artificial Sequence
  Synthetic
guaguauuaaaccauaa

SEQ ID NO: 18890 - RNA, 17 nt, Artificial Sequence
  Synthetic
guuuacuagaaagauaa

SEQ ID NO: 18891 - RNA, 17 nt, Artificial Sequence
  Synthetic
gaccuaagauauccuaa

SEQ ID NO: 18892 - RNA, 17 nt, Artificial Sequence
  Synthetic
guauuagaaugggcuaa

SEQ ID NO: 18893 - RNA, 17 nt, Artificial Sequence
  Synthetic
gcuggauaagauucuaa

SEQ ID NO: 18894 - RNA, 17 nt, Artificial Sequence
  Synthetic
gaucaauaauagagaca

SEQ ID NO: 18895 - RNA, 17 nt, Artificial Sequence
  Synthetic
guguuuaaauauuccca

SEQ ID NO: 18896 - RNA, 17 nt, Artificial Sequence
  Synthetic
gugccacuagugaugca

SEQ ID NO: 18897 - RNA, 17 nt, Artificial Sequence
  Synthetic
guacaagucuaguuuca

SEQ ID NO: 18898 - RNA, 17 nt, Artificial Sequence
  Synthetic
ggcugguagugugaaga

SEQ ID NO: 18899 - RNA, 17 nt, Artificial Sequence
  Synthetic
gugaugcagacaacaga

SEQ ID NO: 18900 - RNA, 17 nt, Artificial Sequence
  Synthetic
gacuaaaacugaguaga

SEQ ID NO: 18901 - RNA, 17 nt, Artificial Sequence
  Synthetic
gguacaaauuucaggga

SEQ ID NO: 18902 - RNA, 17 nt, Artificial Sequence
  Synthetic
gucucucuaagguguga

SEQ ID NO: 18903 - RNA, 17 nt, Artificial Sequence
  Synthetic
guucuuagggugggaua

SEQ ID NO: 18904 - RNA, 17 nt, Artificial Sequence
  Synthetic
guguagggguuagccua

SEQ ID NO: 18905 - RNA, 17 nt, Artificial Sequence
  Synthetic
gccuaucaccuaggcua

SEQ ID NO: 18906 - RNA, 17 nt, Artificial Sequence
  Synthetic
gugugagggucucucua

SEQ ID NO: 18907 - RNA, 17 nt, Artificial Sequence
  Synthetic
gacugaaagcuggcuua

SEQ ID NO: 18908 - RNA, 17 nt, Artificial Sequence
  Synthetic
guauguaggaaaacaac

SEQ ID NO: 18909 - RNA, 17 nt, Artificial Sequence
  Synthetic
guauuaaguauagccac

SEQ ID NO: 18910 - RNA, 17 nt, Artificial Sequence
  Synthetic
gugagauuagaggccac

SEQ ID NO: 18911 - RNA, 17 nt, Artificial Sequence
  Synthetic
gaugagcagauaauuac

SEQ ID NO: 18912 - RNA, 17 nt, Artificial Sequence
  Synthetic
guaucuccaaauaugcc

SEQ ID NO: 18913 - RNA, 17 nt, Artificial Sequence
  Synthetic
gaaugaaugugguaucc

SEQ ID NO: 18914 - RNA, 17 nt, Artificial Sequence
  Synthetic
gacaucaguuggguucc

SEQ ID NO: 18915 - RNA, 17 nt, Artificial Sequence
  Synthetic
guuggaugagggaaugc

SEQ ID NO: 18916 - RNA, 17 nt, Artificial Sequence
  Synthetic
gcuauuuaaacagaauc

SEQ ID NO: 18917 - RNA, 17 nt, Artificial Sequence
  Synthetic
gacugacuauaccuguc

SEQ ID NO: 18918 - RNA, 17 nt, Artificial Sequence
  Synthetic
gucuauugugccaguuc

SEQ ID NO: 18919 - RNA, 17 nt, Artificial Sequence
  Synthetic
gaauugguacaaauuuc

SEQ ID NO: 18920 - RNA, 17 nt, Artificial Sequence
  Synthetic
gaugauuccaagcuuuc

SEQ ID NO: 18921 - RNA, 17 nt, Artificial Sequence
  Synthetic
gauaucuuaggucaaag

SEQ ID NO: 18922 - RNA, 17 nt, Artificial Sequence
  Synthetic
gucuaguuucaaggaag

SEQ ID NO: 18923 - RNA, 17 nt, Artificial Sequence
  Synthetic
gcuaaaguauuacccag

SEQ ID NO: 18924 - RNA, 17 nt, Artificial Sequence
  Synthetic
ggcauucuaaguauuag

SEQ ID NO: 18925 - RNA, 17 nt, Artificial Sequence
  Synthetic
gucagagaaguaaucgg

SEQ ID NO: 18926 - RNA, 17 nt, Artificial Sequence
  Synthetic
gaaguaaucggcggugg

SEQ ID NO: 18927 - RNA, 17 nt, Artificial Sequence
  Synthetic
gcuaccuugguuggaug

SEQ ID NO: 18928 - RNA, 17 nt, Artificial Sequence
  Synthetic
gauugucauuuuagcug

SEQ ID NO: 18929 - RNA, 17 nt, Artificial Sequence
  Synthetic
gaaaugggguauaagug

SEQ ID NO: 18930 - RNA, 17 nt, Artificial Sequence
  Synthetic
gaugguauugcagggug

SEQ ID NO: 18931 - RNA, 17 nt, Artificial Sequence
  Synthetic
gagccaaaaauugggug

SEQ ID NO: 18932 - RNA, 17 nt, Artificial Sequence
  Synthetic
ggcaucucaccagugug

SEQ ID NO: 18933 - RNA, 17 nt, Artificial Sequence
  Synthetic
ggucucucuaaggugug

SEQ ID NO: 18934 - RNA, 17 nt, Artificial Sequence
  Synthetic
gguaagcucaagcauug

SEQ ID NO: 18935 - RNA, 17 nt, Artificial Sequence
  Synthetic
guauuuaccauauauug

SEQ ID NO: 18936 - RNA, 17 nt, Artificial Sequence
  Synthetic
gguuuccacucaacaau

SEQ ID NO: 18937 - RNA, 17 nt, Artificial Sequence
  Synthetic
gcugguagugugaagau

SEQ ID NO: 18938 - RNA, 17 nt, Artificial Sequence
  Synthetic
gugcaaagcuuucagau

SEQ ID NO: 18939 - RNA, 17 nt, Artificial Sequence
  Synthetic
gaaggguguuaucaacu

SEQ ID NO: 18940 - RNA, 17 nt, Artificial Sequence
  Synthetic
gaauugaauaugagacu

SEQ ID NO: 18941 - RNA, 17 nt, Artificial Sequence
  Synthetic
ggaaggcaguggucccu

SEQ ID NO: 18942 - RNA, 17 nt, Artificial Sequence
  Synthetic
gugaaaauaucacuucu

SEQ ID NO: 18943 - RNA, 17 nt, Artificial Sequence
  Synthetic
ggagccaaaaauugggu

SEQ ID NO: 18944 - RNA, 17 nt, Artificial Sequence
  Synthetic
ggauuggcuaccuuggu

SEQ ID NO: 18945 - RNA, 17 nt, Artificial Sequence
  Synthetic
gucacuguauugucugu

SEQ ID NO: 18946 - RNA, 17 nt, Artificial Sequence
  Synthetic
gcaucucaccagugugu

SEQ ID NO: 18947 - RNA, 17 nt, Artificial Sequence
  Synthetic
gaaguagaagaacuauu

SEQ ID NO: 18948 - RNA, 17 nt, Artificial Sequence
  Synthetic
guuugucuuagauuauu

SEQ ID NO: 18949 - RNA, 17 nt, Artificial Sequence
  Synthetic
gauuagcuuauauacuu

SEQ ID NO: 18950 - RNA, 17 nt, Artificial Sequence
  Synthetic
gaaggcaguggucccuu

SEQ ID NO: 18951 - RNA, 20 nt, Artificial Sequence
  Synthetic
gagugcauaaagguugaaaa

SEQ ID NO: 18952 - RNA, 20 nt, Artificial Sequence
  Synthetic
gcuauucuguagggagacaa

SEQ ID NO: 18953 - RNA, 20 nt, Artificial Sequence
  Synthetic
gauacuaaauaaguuagcaa

SEQ ID NO: 18954 - RNA, 20 nt, Artificial Sequence
  Synthetic
gaggguugauaagaagagaa

SEQ ID NO: 18955 - RNA, 20 nt, Artificial Sequence
  Synthetic
gccguuuacuagaaagauaa

SEQ ID NO: 18956 - RNA, 20 nt, Artificial Sequence
  Synthetic
ggguguagggguuagccuaa

SEQ ID NO: 18957 - RNA, 20 nt, Artificial Sequence
  Synthetic
ggggcuggauaagauucuaa

SEQ ID NO: 18958 - RNA, 20 nt, Artificial Sequence
  Synthetic
gguauaaguguggaguguaa

SEQ ID NO: 18959 - RNA, 20 nt, Artificial Sequence
  Synthetic
ggaagauccaauaggauuaa

SEQ ID NO: 18960 - RNA, 20 nt, Artificial Sequence
  Synthetic
ggcuggcauagaguaagaca

SEQ ID NO: 18961 - RNA, 20 nt, Artificial Sequence
  Synthetic
ggcuauucuguagggagaca

SEQ ID NO: 18962 - RNA, 20 nt, Artificial Sequence
  Synthetic
gaaguguuuaaauauuccca

SEQ ID NO: 18963 - RNA, 20 nt, Artificial Sequence
  Synthetic
gugcuauuuaaacagaauca

SEQ ID NO: 18964 - RNA, 20 nt, Artificial Sequence
  Synthetic
ggauugcuugauguuauuca

SEQ ID NO: 18965 - RNA, 20 nt, Artificial Sequence
  Synthetic
gauguacaagucuaguuuca

SEQ ID NO: 18966 - RNA, 20 nt, Artificial Sequence
  Synthetic
gggggcugguagugugaaga

SEQ ID NO: 18967 - RNA, 20 nt, Artificial Sequence
  Synthetic
gcugugaugcagacaacaga

SEQ ID NO: 18968 - RNA, 20 nt, Artificial Sequence
  Synthetic
gcaagugcaaagcuuucaga

SEQ ID NO: 18969 - RNA, 20 nt, Artificial Sequence
  Synthetic
ggcauagaguaagacaggga

SEQ ID NO: 18970 - RNA, 20 nt, Artificial Sequence
  Synthetic
guuguucuuagggugggaua

SEQ ID NO: 18971 - RNA, 20 nt, Artificial Sequence
  Synthetic
gggguguagggguuagccua

SEQ ID NO: 18972 - RNA, 20 nt, Artificial Sequence
  Synthetic
gucugguuugaagaacagua

SEQ ID NO: 18973 - RNA, 20 nt, Artificial Sequence
  Synthetic
gccagguuaaguuguucuua

SEQ ID NO: 18974 - RNA, 20 nt, Artificial Sequence
  Synthetic
gaguuuuaaacagaaguaac

SEQ ID NO: 18975 - RNA, 20 nt, Artificial Sequence
  Synthetic
gacugaaacuccccacacac

SEQ ID NO: 18976 - RNA, 20 nt, Artificial Sequence
  Synthetic
gcuaagagacuccugaaucc

SEQ ID NO: 18977 - RNA, 20 nt, Artificial Sequence
  Synthetic
guuuuaguagaaaccuaauc

SEQ ID NO: 18978 - RNA, 20 nt, Artificial Sequence
  Synthetic
ggauuagggaaugcagacuc

SEQ ID NO: 18979 - RNA, 20 nt, Artificial Sequence
  Synthetic
ggagucuauugugccaguuc

SEQ ID NO: 18980 - RNA, 20 nt, Artificial Sequence
  Synthetic
gcuugacaucaguuggguuc

SEQ ID NO: 18981 - RNA, 20 nt, Artificial Sequence
  Synthetic
gauaagauucuaaaggaaag

SEQ ID NO: 18982 - RNA, 20 nt, Artificial Sequence
  Synthetic
gggucaauuguauuagcaag

SEQ ID NO: 18983 - RNA, 20 nt, Artificial Sequence
  Synthetic
ggcuuaacccaucuauuaag

SEQ ID NO: 18984 - RNA, 20 nt, Artificial Sequence
  Synthetic
gcauauuggaccagacacag

SEQ ID NO: 18985 - RNA, 20 nt, Artificial Sequence
  Synthetic
gcauaugagaaaagucacag

SEQ ID NO: 18986 - RNA, 20 nt, Artificial Sequence
  Synthetic
gccuagaugauuauuaauag

SEQ ID NO: 18987 - RNA, 20 nt, Artificial Sequence
  Synthetic
guaaucggcgguggagguag

SEQ ID NO: 18988 - RNA, 20 nt, Artificial Sequence
  Synthetic
gaucaauaauagagacaagg

SEQ ID NO: 18989 - RNA, 20 nt, Artificial Sequence
  Synthetic
gucuaguuucaaggaagagg

SEQ ID NO: 18990 - RNA, 20 nt, Artificial Sequence
  Synthetic
guuuacuaacucaaucuagg

SEQ ID NO: 18991 - RNA, 20 nt, Artificial Sequence
  Synthetic
gucagagaaguaaucggcgg

SEQ ID NO: 18992 - RNA, 20 nt, Artificial Sequence
  Synthetic
gggcugguagugugaagaug

SEQ ID NO: 18993 - RNA, 20 nt, Artificial Sequence
  Synthetic
guuacauaaaaagagaggug

SEQ ID NO: 18994 - RNA, 20 nt, Artificial Sequence
  Synthetic
gagggucucucuaaggugug

SEQ ID NO: 18995 - RNA, 20 nt, Artificial Sequence
  Synthetic
gcuuugaaggaagauccaau

SEQ ID NO: 18996 - RNA, 20 nt, Artificial Sequence
  Synthetic
gagcuuucuaguauuagaau

SEQ ID NO: 18997 - RNA, 20 nt, Artificial Sequence
  Synthetic
ggggcugguagugugaagau

SEQ ID NO: 18998 - RNA, 20 nt, Artificial Sequence
  Synthetic
gucuuuuccucuuaauagau

SEQ ID NO: 18999 - RNA, 20 nt, Artificial Sequence
  Synthetic
gcagaaggguguuaucaacu

SEQ ID NO: 19000 - RNA, 20 nt, Artificial Sequence
  Synthetic
gaagaauugaauaugagacu

SEQ ID NO: 19001 - RNA, 20 nt, Artificial Sequence
  Synthetic
guuacaacagucuuuauacu

SEQ ID NO: 19002 - RNA, 20 nt, Artificial Sequence
  Synthetic
guuaccuggauuggcuaccu

SEQ ID NO: 19003 - RNA, 20 nt, Artificial Sequence
  Synthetic
guuacucaguccagaaagcu

SEQ ID NO: 19004 - RNA, 20 nt, Artificial Sequence
  Synthetic
ggaguuuacuaacucaaucu

SEQ ID NO: 19005 - RNA, 20 nt, Artificial Sequence
  Synthetic
gauuagggaaugcagacucu

SEQ ID NO: 19006 - RNA, 20 nt, Artificial Sequence
  Synthetic
ggaaaguuguccaagauagu

SEQ ID NO: 19007 - RNA, 20 nt, Artificial Sequence
  Synthetic
guauuagagguuaaggaggu

SEQ ID NO: 19008 - RNA, 20 nt, Artificial Sequence
  Synthetic
ggaagcagugcugcugcugu

SEQ ID NO: 19009 - RNA, 20 nt, Artificial Sequence
  Synthetic
gaagucacuguauugucugu

SEQ ID NO: 19010 - RNA, 20 nt, Artificial Sequence
  Synthetic
guuacccaauaaaaaaaauu

SEQ ID NO: 19011 - RNA, 20 nt, Artificial Sequence
  Synthetic
gcuuucaggagccaaaaauu

SEQ ID NO: 19012 - RNA, 20 nt, Artificial Sequence
  Synthetic
ggcugccuuuuaguaguauu

SEQ ID NO: 19013 - RNA, 20 nt, Artificial Sequence
  Synthetic
gaggaaggcaguggucccuu

SEQ ID NO: 19014 - RNA, 20 nt, Artificial Sequence
  Synthetic
guuuuggauggagcuugguu

SEQ ID NO: 19015 - RNA, 20 nt, Artificial Sequence
  Synthetic
ggguuugauuagauaaauuu

SEQ ID NO: 19016 - RNA, 20 nt, Artificial Sequence
  Synthetic
guuguuaucucugaaauuuu

SEQ ID NO: 19017 - RNA, 20 nt, Artificial Sequence
  Synthetic
gggcucccccacccaauuuu

SEQ ID NO: 19018 - RNA, 17 nt, Artificial Sequence
  Synthetic
agcuaugcccuuaaaaa

SEQ ID NO: 19019 - RNA, 17 nt, Artificial Sequence
  Synthetic
aucaucuaggcugcaaa

SEQ ID NO: 19020 - RNA, 17 nt, Artificial Sequence
  Synthetic
accuucauguugauaaa

SEQ ID NO: 19021 - RNA, 17 nt, Artificial Sequence
  Synthetic
uuccuaauacuacuaaa

SEQ ID NO: 19022 - RNA, 17 nt, Artificial Sequence
  Synthetic
uauuagaaugggcuaaa

SEQ ID NO: 19023 - RNA, 17 nt, Artificial Sequence
  Synthetic
ucacgugguguuuuaaa

SEQ ID NO: 19024 - RNA, 17 nt, Artificial Sequence
  Synthetic
uaccauuaucuacacaa

SEQ ID NO: 19025 - RNA, 17 nt, Artificial Sequence
  Synthetic
auucuguagggagacaa

SEQ ID NO: 19026 - RNA, 17 nt, Artificial Sequence
  Synthetic
acuaaauaaguuagcaa

SEQ ID NO: 19027 - RNA, 17 nt, Artificial Sequence
  Synthetic
agccagcuuucagucaa

SEQ ID NO: 19028 - RNA, 17 nt, Artificial Sequence
  Synthetic
uguugauaaagggucaa

SEQ ID NO: 19029 - RNA, 17 nt, Artificial Sequence
  Synthetic
acugaugucaagcagaa

SEQ ID NO: 19030 - RNA, 17 nt, Artificial Sequence
  Synthetic
uuuaguaguauuaggaa

SEQ ID NO: 19031 - RNA, 17 nt, Artificial Sequence
  Synthetic
uaagaaagacuccugaa

SEQ ID NO: 19032 - RNA, 17 nt, Artificial Sequence
  Synthetic
aagcaaagagugcauaa

SEQ ID NO: 19033 - RNA, 17 nt, Artificial Sequence
  Synthetic
acccauuguguagauaa

SEQ ID NO: 19034 - RNA, 17 nt, Artificial Sequence
  Synthetic
aaccuucauguugauaa

SEQ ID NO: 19035 - RNA, 17 nt, Artificial Sequence
  Synthetic
uugguguaguucuauaa

SEQ ID NO: 19036 - RNA, 17 nt, Artificial Sequence
  Synthetic
uguagggguuagccuaa

SEQ ID NO: 19037 - RNA, 17 nt, Artificial Sequence
  Synthetic
auaaguguggaguguaa

SEQ ID NO: 19038 - RNA, 17 nt, Artificial Sequence
  Synthetic
agauccaauaggauuaa

SEQ ID NO: 19039 - RNA, 17 nt, Artificial Sequence
  Synthetic
ucaacuuuaucuguuaa

SEQ ID NO: 19040 - RNA, 17 nt, Artificial Sequence
  Synthetic
uaccuuucaauguuuaa

SEQ ID NO: 19041 - RNA, 17 nt, Artificial Sequence
  Synthetic
uagcaauggucuaaaca

SEQ ID NO: 19042 - RNA, 17 nt, Artificial Sequence
  Synthetic
acaaucaaaugggaaca

SEQ ID NO: 19043 - RNA, 17 nt, Artificial Sequence
  Synthetic
accuauaaggaauaaca

SEQ ID NO: 19044 - RNA, 17 nt, Artificial Sequence
  Synthetic
uggcauagaguaagaca

SEQ ID NO: 19045 - RNA, 17 nt, Artificial Sequence
  Synthetic
uauucuguagggagaca

SEQ ID NO: 19046 - RNA, 17 nt, Artificial Sequence
  Synthetic
uuacaauucuuauuaca

SEQ ID NO: 19047 - RNA, 17 nt, Artificial Sequence
  Synthetic
auucccucauccaacca

SEQ ID NO: 19048 - RNA, 17 nt, Artificial Sequence
  Synthetic
uaaagacuucacccuca

SEQ ID NO: 19049 - RNA, 17 nt, Artificial Sequence
  Synthetic
aagccagcuuucaguca

SEQ ID NO: 19050 - RNA, 17 nt, Artificial Sequence
  Synthetic
aucuaaaagcuaauuca

SEQ ID NO: 19051 - RNA, 17 nt, Artificial Sequence
  Synthetic
uugcuugauguuauuca

SEQ ID NO: 19052 - RNA, 17 nt, Artificial Sequence
  Synthetic
ucuaguuucaaggaaga

SEQ ID NO: 19053 - RNA, 17 nt, Artificial Sequence
  Synthetic
aacugaugucaagcaga

SEQ ID NO: 19054 - RNA, 17 nt, Artificial Sequence
  Synthetic
agugcaaagcuuucaga

SEQ ID NO: 19055 - RNA, 17 nt, Artificial Sequence
  Synthetic
acccuuuaucaacauga

SEQ ID NO: 19056 - RNA, 17 nt, Artificial Sequence
  Synthetic
cuaccuugguuggauga

SEQ ID NO: 19057 - RNA, 17 nt, Artificial Sequence
  Synthetic
augaaaagcagcuauga

SEQ ID NO: 19058 - RNA, 17 nt, Artificial Sequence
  Synthetic
uuaaagaaugacuguga

SEQ ID NO: 19059 - RNA, 17 nt, Artificial Sequence
  Synthetic
cggugucuucugaaaua

SEQ ID NO: 19060 - RNA, 17 nt, Artificial Sequence
  Synthetic
cuagaugauuauuaaua

SEQ ID NO: 19061 - RNA, 17 nt, Artificial Sequence
  Synthetic
acuaauuguaguacaua

SEQ ID NO: 19062 - RNA, 17 nt, Artificial Sequence
  Synthetic
aaauuacagaaccuaua

SEQ ID NO: 19063 - RNA, 17 nt, Artificial Sequence
  Synthetic
ugaucauugccucacua

SEQ ID NO: 19064 - RNA, 17 nt, Artificial Sequence
  Synthetic
agugcucguaaagacua

SEQ ID NO: 19065 - RNA, 17 nt, Artificial Sequence
  Synthetic
ugaccuaagauauccua

SEQ ID NO: 19066 - RNA, 17 nt, Artificial Sequence
  Synthetic
aaucggcgguggaggua

SEQ ID NO: 19067 - RNA, 17 nt, Artificial Sequence
  Synthetic
acucuauuuagagugua

SEQ ID NO: 19068 - RNA, 17 nt, Artificial Sequence
  Synthetic
agguuaaguuguucuua

SEQ ID NO: 19069 - RNA, 17 nt, Artificial Sequence
  Synthetic
uaucaacaugaagguua

SEQ ID NO: 19070 - RNA, 17 nt, Artificial Sequence
  Synthetic
cuaaguauuagagguua

SEQ ID NO: 19071 - RNA, 17 nt, Artificial Sequence
  Synthetic
cuauuauucaacauuua

SEQ ID NO: 19072 - RNA, 17 nt, Artificial Sequence
  Synthetic
ucuuuacgagcacuuua

SEQ ID NO: 19073 - RNA, 17 nt, Artificial Sequence
  Synthetic
caagccuguauuguuua

SEQ ID NO: 19074 - RNA, 17 nt, Artificial Sequence
  Synthetic
cuuaccguaauagcaac

SEQ ID NO: 19075 - RNA, 17 nt, Artificial Sequence
  Synthetic
ucaucacuugccugaac

SEQ ID NO: 19076 - RNA, 17 nt, Artificial Sequence
  Synthetic
aaccuauaaggaauaac

SEQ ID NO: 19077 - RNA, 17 nt, Artificial Sequence
  Synthetic
cuuauucuuguaauaac

SEQ ID NO: 19078 - RNA, 17 nt, Artificial Sequence
  Synthetic
uuucuggacugaguaac

SEQ ID NO: 19079 - RNA, 17 nt, Artificial Sequence
  Synthetic
ugaaacuccccacacac

SEQ ID NO: 19080 - RNA, 17 nt, Artificial Sequence
  Synthetic
cguauuucagaagacac

SEQ ID NO: 19081 - RNA, 17 nt, Artificial Sequence
  Synthetic
cauuucaacuuauacac

SEQ ID NO: 19082 - RNA, 17 nt, Artificial Sequence
  Synthetic
uucuguuuaaauagcac

SEQ ID NO: 19083 - RNA, 17 nt, Artificial Sequence
  Synthetic
auagaauuuugcaucac

SEQ ID NO: 19084 - RNA, 17 nt, Artificial Sequence
  Synthetic
cuggcauagaguaagac

SEQ ID NO: 19085 - RNA, 17 nt, Artificial Sequence
  Synthetic
uguucuucaaaccagac

SEQ ID NO: 19086 - RNA, 17 nt, Artificial Sequence
  Synthetic
agugccuagcacuugac

SEQ ID NO: 19087 - RNA, 17 nt, Artificial Sequence
  Synthetic
uacaacagucuuuauac

SEQ ID NO: 19088 - RNA, 17 nt, Artificial Sequence
  Synthetic
caaauuccaagacuuac

SEQ ID NO: 19089 - RNA, 17 nt, Artificial Sequence
  Synthetic
cuaagaacaacuuaacc

SEQ ID NO: 19090 - RNA, 17 nt, Artificial Sequence
  Synthetic
cuacuuccacuacuacc

SEQ ID NO: 19091 - RNA, 17 nt, Artificial Sequence
  Synthetic
cuaacaccuacccuacc

SEQ ID NO: 19092 - RNA, 17 nt, Artificial Sequence
  Synthetic
uuacugugaauggugcc

SEQ ID NO: 19093 - RNA, 17 nt, Artificial Sequence
  Synthetic
accaagguagccaaucc

SEQ ID NO: 19094 - RNA, 17 nt, Artificial Sequence
  Synthetic
aagagacuccugaaucc

SEQ ID NO: 19095 - RNA, 17 nt, Artificial Sequence
  Synthetic
uauagcucugauaaucc

SEQ ID NO: 19096 - RNA, 17 nt, Artificial Sequence
  Synthetic
aagacagcuggcuaucc

SEQ ID NO: 19097 - RNA, 17 nt, Artificial Sequence
  Synthetic
auuagcaaguggacucc

SEQ ID NO: 19098 - RNA, 17 nt, Artificial Sequence
  Synthetic
uucuuuugauauacucc

SEQ ID NO: 19099 - RNA, 17 nt, Artificial Sequence
  Synthetic
ugcccuugacugaaagc

SEQ ID NO: 19100 - RNA, 17 nt, Artificial Sequence
  Synthetic
uaaauuuggugucaggc

SEQ ID NO: 19101 - RNA, 17 nt, Artificial Sequence
  Synthetic
uagugugaagauggggc

SEQ ID NO: 19102 - RNA, 17 nt, Artificial Sequence
  Synthetic
ucauguuagacauaugc

SEQ ID NO: 19103 - RNA, 17 nt, Artificial Sequence
  Synthetic
caagacuucacaccugc

SEQ ID NO: 19104 - RNA, 17 nt, Artificial Sequence
  Synthetic
agcagacccaaaucugc

SEQ ID NO: 19105 - RNA, 17 nt, Artificial Sequence
  Synthetic
auuuaucucgaaauugc

SEQ ID NO: 19106 - RNA, 17 nt, Artificial Sequence
  Synthetic
uuaguagaaaccuaauc

SEQ ID NO: 19107 - RNA, 17 nt, Artificial Sequence
  Synthetic
uuagggaaugcagacuc

SEQ ID NO: 19108 - RNA, 17 nt, Artificial Sequence
  Synthetic
agcugugcauuuuccuc

SEQ ID NO: 19109 - RNA, 17 nt, Artificial Sequence
  Synthetic
acuaaggcuuauuucuc

SEQ ID NO: 19110 - RNA, 17 nt, Artificial Sequence
  Synthetic
uaacuuuucuuauuguc

SEQ ID NO: 19111 - RNA, 17 nt, Artificial Sequence
  Synthetic
accaaaacuuuauuguc

SEQ ID NO: 19112 - RNA, 17 nt, Artificial Sequence
  Synthetic
cuggcuauccaggauuc

SEQ ID NO: 19113 - RNA, 17 nt, Artificial Sequence
  Synthetic
ugacaucaguuggguuc

SEQ ID NO: 19114 - RNA, 17 nt, Artificial Sequence
  Synthetic
ucaauuguauuagcaag

SEQ ID NO: 19115 - RNA, 17 nt, Artificial Sequence
  Synthetic
aguaggcuuccuauaag

SEQ ID NO: 19116 - RNA, 17 nt, Artificial Sequence
  Synthetic
uuaacccaucuauuaag

SEQ ID NO: 19117 - RNA, 17 nt, Artificial Sequence
  Synthetic
uauuggaccagacacag

SEQ ID NO: 19118 - RNA, 17 nt, Artificial Sequence
  Synthetic
cuaguuucaaggaagag

SEQ ID NO: 19119 - RNA, 17 nt, Artificial Sequence
  Synthetic
uaccaaauuguauugag

SEQ ID NO: 19120 - RNA, 17 nt, Artificial Sequence
  Synthetic
acaccaaauuuauugag

SEQ ID NO: 19121 - RNA, 17 nt, Artificial Sequence
  Synthetic
aaaguuguccaagauag

SEQ ID NO: 19122 - RNA, 17 nt, Artificial Sequence
  Synthetic
uuuccgugcaucacuag

SEQ ID NO: 19123 - RNA, 17 nt, Artificial Sequence
  Synthetic
cuugauccagguaguag

SEQ ID NO: 19124 - RNA, 17 nt, Artificial Sequence
  Synthetic
aucggcgguggagguag

SEQ ID NO: 19125 - RNA, 17 nt, Artificial Sequence
  Synthetic
aagagaaagggguguag

SEQ ID NO: 19126 - RNA, 17 nt, Artificial Sequence
  Synthetic
ucucugggugagauuag

SEQ ID NO: 19127 - RNA, 17 nt, Artificial Sequence
  Synthetic
aucaacaugaagguuag

SEQ ID NO: 19128 - RNA, 17 nt, Artificial Sequence
  Synthetic
ugugagaaaaaguuuag

SEQ ID NO: 19129 - RNA, 17 nt, Artificial Sequence
  Synthetic
aaaucagugcuuuuucg

SEQ ID NO: 19130 - RNA, 17 nt, Artificial Sequence
  Synthetic
caauaauagagacaagg

SEQ ID NO: 19131 - RNA, 17 nt, Artificial Sequence
  Synthetic
aguauuagagguuaagg

SEQ ID NO: 19132 - RNA, 17 nt, Artificial Sequence
  Synthetic
uucaacuuauacacagg

SEQ ID NO: 19133 - RNA, 17 nt, Artificial Sequence
  Synthetic
auuagagguuaaggagg

SEQ ID NO: 19134 - RNA, 17 nt, Artificial Sequence
  Synthetic
uacuaacucaaucuagg

SEQ ID NO: 19135 - RNA, 17 nt, Artificial Sequence
  Synthetic
ucggcgguggagguagg

SEQ ID NO: 19136 - RNA, 17 nt, Artificial Sequence
  Synthetic
agagaaguaaucggcgg

SEQ ID NO: 19137 - RNA, 17 nt, Artificial Sequence
  Synthetic
cauagaguaagacaggg

SEQ ID NO: 19138 - RNA, 17 nt, Artificial Sequence
  Synthetic
uuaaguuguucuuaggg

SEQ ID NO: 19139 - RNA, 17 nt, Artificial Sequence
  Synthetic
aggagccaaaaauuggg

SEQ ID NO: 19140 - RNA, 17 nt, Artificial Sequence
  Synthetic
agccaaaaauugggugg

SEQ ID NO: 19141 - RNA, 17 nt, Artificial Sequence
  Synthetic
cugguagugugaagaug

SEQ ID NO: 19142 - RNA, 17 nt, Artificial Sequence
  Synthetic
uaucaauaucuaagaug

SEQ ID NO: 19143 - RNA, 17 nt, Artificial Sequence
  Synthetic
aucuguuaguaaugcug

SEQ ID NO: 19144 - RNA, 17 nt, Artificial Sequence
  Synthetic
uuaagggcauagcucug

SEQ ID NO: 19145 - RNA, 17 nt, Artificial Sequence
  Synthetic
aacucaguaccauagug

SEQ ID NO: 19146 - RNA, 17 nt, Artificial Sequence
  Synthetic
cuguuaguaaugcugug

SEQ ID NO: 19147 - RNA, 17 nt, Artificial Sequence
  Synthetic
caucucaccagugugug

SEQ ID NO: 19148 - RNA, 17 nt, Artificial Sequence
  Synthetic
cucucuuuuaacuauug

SEQ ID NO: 19149 - RNA, 17 nt, Artificial Sequence
  Synthetic
ugaguggaaauuuuuug

SEQ ID NO: 19150 - RNA, 17 nt, Artificial Sequence
  Synthetic
uuucaggagccaaaaau

SEQ ID NO: 19151 - RNA, 17 nt, Artificial Sequence
  Synthetic
accauuaucuacacaau

SEQ ID NO: 19152 - RNA, 17 nt, Artificial Sequence
  Synthetic
augggcuaaagggcaau

SEQ ID NO: 19153 - RNA, 17 nt, Artificial Sequence
  Synthetic
cuuucuaguauuagaau

SEQ ID NO: 19154 - RNA, 17 nt, Artificial Sequence
  Synthetic
auggcaugaguacgaau

SEQ ID NO: 19155 - RNA, 17 nt, Artificial Sequence
  Synthetic
ccuagaugauuauuaau

SEQ ID NO: 19156 - RNA, 17 nt, Artificial Sequence
  Synthetic
uuuuccucuuaauagau

SEQ ID NO: 19157 - RNA, 17 nt, Artificial Sequence
  Synthetic
aaaaaaguuaccuggau

SEQ ID NO: 19158 - RNA, 17 nt, Artificial Sequence
  Synthetic
uuauccauuaauccuau

SEQ ID NO: 19159 - RNA, 17 nt, Artificial Sequence
  Synthetic
aaugcuugaccacuuau

SEQ ID NO: 19160 - RNA, 17 nt, Artificial Sequence
  Synthetic
ucccuguuauuccuuau

SEQ ID NO: 19161 - RNA, 17 nt, Artificial Sequence
  Synthetic
acaacagucuuuauacu

SEQ ID NO: 19162 - RNA, 17 nt, Artificial Sequence
  Synthetic
uugcuucaccugcuacu

SEQ ID NO: 19163 - RNA, 17 nt, Artificial Sequence
  Synthetic
aucuuauagagauuacu

SEQ ID NO: 19164 - RNA, 17 nt, Artificial Sequence
  Synthetic
uuuugagccuaucaccu

SEQ ID NO: 19165 - RNA, 17 nt, Artificial Sequence
  Synthetic
accuggauuggcuaccu

SEQ ID NO: 19166 - RNA, 17 nt, Artificial Sequence
  Synthetic
cacuuguugacaguccu

SEQ ID NO: 19167 - RNA, 17 nt, Artificial Sequence
  Synthetic
acucaguccagaaagcu

SEQ ID NO: 19168 - RNA, 17 nt, Artificial Sequence
  Synthetic
acucauaagggaccgcu

SEQ ID NO: 19169 - RNA, 17 nt, Artificial Sequence
  Synthetic
aaauuuggugucaggcu

SEQ ID NO: 19170 - RNA, 17 nt, Artificial Sequence
  Synthetic
agccuaucaccuaggcu

SEQ ID NO: 19171 - RNA, 17 nt, Artificial Sequence
  Synthetic
uauaccugucaagugcu

SEQ ID NO: 19172 - RNA, 17 nt, Artificial Sequence
  Synthetic
ccuauuaauaaucaucu

SEQ ID NO: 19173 - RNA, 17 nt, Artificial Sequence
  Synthetic
uagggaaugcagacucu

SEQ ID NO: 19174 - RNA, 17 nt, Artificial Sequence
  Synthetic
uagagagaaacaucucu

SEQ ID NO: 19175 - RNA, 17 nt, Artificial Sequence
  Synthetic
cuaaggcuuauuucucu

SEQ ID NO: 19176 - RNA, 17 nt, Artificial Sequence
  Synthetic
uaauugccaguaagucu

SEQ ID NO: 19177 - RNA, 17 nt, Artificial Sequence
  Synthetic
auuuucucgguauuucu

SEQ ID NO: 19178 - RNA, 17 nt, Artificial Sequence
  Synthetic
auuuuugacuauacagu

SEQ ID NO: 19179 - RNA, 17 nt, Artificial Sequence
  Synthetic
uucugcuugacaucagu

SEQ ID NO: 19180 - RNA, 17 nt, Artificial Sequence
  Synthetic
accaaauuguauugagu

SEQ ID NO: 19181 - RNA, 17 nt, Artificial Sequence
  Synthetic
aaguuguccaagauagu

SEQ ID NO: 19182 - RNA, 17 nt, Artificial Sequence
  Synthetic
caaauagagauguuagu

SEQ ID NO: 19183 - RNA, 17 nt, Artificial Sequence
  Synthetic
ugugaauggugccaggu

SEQ ID NO: 19184 - RNA, 17 nt, Artificial Sequence
  Synthetic
uaaucggcgguggaggu

SEQ ID NO: 19185 - RNA, 17 nt, Artificial Sequence
  Synthetic
ugaugguauugcagggu

SEQ ID NO: 19186 - RNA, 17 nt, Artificial Sequence
  Synthetic
auggugccagguagggu

SEQ ID NO: 19187 - RNA, 17 nt, Artificial Sequence
  Synthetic
uaaguuguucuuagggu

SEQ ID NO: 19188 - RNA, 17 nt, Artificial Sequence
  Synthetic
uugacuauacagugggu

SEQ ID NO: 19189 - RNA, 17 nt, Artificial Sequence
  Synthetic
aaagcuguuucguaugu

SEQ ID NO: 19190 - RNA, 17 nt, Artificial Sequence
  Synthetic
ucuguuaguaaugcugu

SEQ ID NO: 19191 - RNA, 17 nt, Artificial Sequence
  Synthetic
agcagugcugcugcugu

SEQ ID NO: 19192 - RNA, 17 nt, Artificial Sequence
  Synthetic
uuuuuaggcuauucugu

SEQ ID NO: 19193 - RNA, 17 nt, Artificial Sequence
  Synthetic
uucaggagccaaaaauu

SEQ ID NO: 19194 - RNA, 17 nt, Artificial Sequence
  Synthetic
acccacucaauacaauu

SEQ ID NO: 19195 - RNA, 17 nt, Artificial Sequence
  Synthetic
augcuaauaauacaauu

SEQ ID NO: 19196 - RNA, 17 nt, Artificial Sequence
  Synthetic
aauaucaccaacucauu

SEQ ID NO: 19197 - RNA, 17 nt, Artificial Sequence
  Synthetic
aucucugcaaacauauu

SEQ ID NO: 19198 - RNA, 17 nt, Artificial Sequence
  Synthetic
acuuaaccuggcauauu

SEQ ID NO: 19199 - RNA, 17 nt, Artificial Sequence
  Synthetic
caacuaacaucucuauu

SEQ ID NO: 19200 - RNA, 17 nt, Artificial Sequence
  Synthetic
ugccuuuuaguaguauu

SEQ ID NO: 19201 - RNA, 17 nt, Artificial Sequence
  Synthetic
caaugguugucuguauu

SEQ ID NO: 19202 - RNA, 17 nt, Artificial Sequence
  Synthetic
auacuuagaaugcccuu

SEQ ID NO: 19203 - RNA, 17 nt, Artificial Sequence
  Synthetic
uugcaggguggggccuu

SEQ ID NO: 19204 - RNA, 17 nt, Artificial Sequence
  Synthetic
augugcaaaaauagcuu

SEQ ID NO: 19205 - RNA, 17 nt, Artificial Sequence
  Synthetic
cagguuaaguuguucuu

SEQ ID NO: 19206 - RNA, 17 nt, Artificial Sequence
  Synthetic
uuaguuagcauaaaguu

SEQ ID NO: 19207 - RNA, 17 nt, Artificial Sequence
  Synthetic
ucugcuugacaucaguu

SEQ ID NO: 19208 - RNA, 17 nt, Artificial Sequence
  Synthetic
uuaucaacaugaagguu

SEQ ID NO: 19209 - RNA, 17 nt, Artificial Sequence
  Synthetic
agugcuuuuucgagguu

SEQ ID NO: 19210 - RNA, 17 nt, Artificial Sequence
  Synthetic
uuggauggagcuugguu

SEQ ID NO: 19211 - RNA, 17 nt, Artificial Sequence
  Synthetic
uucauggaaagcuuguu

SEQ ID NO: 19212 - RNA, 17 nt, Artificial Sequence
  Synthetic
uuguguacuugugauuu

SEQ ID NO: 19213 - RNA, 17 nt, Artificial Sequence
  Synthetic
uaugcacucuuugcuuu

SEQ ID NO: 19214 - RNA, 17 nt, Artificial Sequence
  Synthetic
uccugacaauaaaguuu

SEQ ID NO: 19215 - RNA, 17 nt, Artificial Sequence
  Synthetic
uggauggagcuugguuu

SEQ ID NO: 19216 - RNA, 17 nt, Artificial Sequence
  Synthetic
agagcuauauuguguuu

SEQ ID NO: 19217 - RNA, 17 nt, Artificial Sequence
  Synthetic
cucccccacccaauuuu

SEQ ID NO: 19218 - RNA, 20 nt, Artificial Sequence
  Synthetic
cagagcuaugcccuuaaaaa

SEQ ID NO: 19219 - RNA, 20 nt, Artificial Sequence
  Synthetic
ugcuucagaagucuauaaaa

SEQ ID NO: 19220 - RNA, 20 nt, Artificial Sequence
  Synthetic
auaaucaucuaggcugcaaa

SEQ ID NO: 19221 - RNA, 20 nt, Artificial Sequence
  Synthetic
cagcuaaaaugacaaucaaa

SEQ ID NO: 19222 - RNA, 20 nt, Artificial Sequence
  Synthetic
cguguuauucagccaauaaa

SEQ ID NO: 19223 - RNA, 20 nt, Artificial Sequence
  Synthetic
cuaaccuucauguugauaaa

SEQ ID NO: 19224 - RNA, 20 nt, Artificial Sequence
  Synthetic
ccauuccuaauacuacuaaa

SEQ ID NO: 19225 - RNA, 20 nt, Artificial Sequence
  Synthetic
uaguauuagaaugggcuaaa

SEQ ID NO: 19226 - RNA, 20 nt, Artificial Sequence
  Synthetic
cccauuaucuuucuaguaaa

SEQ ID NO: 19227 - RNA, 20 nt, Artificial Sequence
  Synthetic
uuaauggauaaguugaacaa

SEQ ID NO: 19228 - RNA, 20 nt, Artificial Sequence
  Synthetic
uuuuaccauuaucuacacaa

SEQ ID NO: 19229 - RNA, 20 nt, Artificial Sequence
  Synthetic
cuagguuuaauuuuguacaa

SEQ ID NO: 19230 - RNA, 20 nt, Artificial Sequence
  Synthetic
aaguguuuaaauauucccaa

SEQ ID NO: 19231 - RNA, 20 nt, Artificial Sequence
  Synthetic
ucaaaagaauaaggcaucaa

SEQ ID NO: 19232 - RNA, 20 nt, Artificial Sequence
  Synthetic
auaagccagcuuucagucaa

SEQ ID NO: 19233 - RNA, 20 nt, Artificial Sequence
  Synthetic
ccaacugaugucaagcagaa

SEQ ID NO: 19234 - RNA, 20 nt, Artificial Sequence
  Synthetic
agagcuuucuaguauuagaa

SEQ ID NO: 19235 - RNA, 20 nt, Artificial Sequence
  Synthetic
cuaaaacugaguagaaggaa

SEQ ID NO: 19236 - RNA, 20 nt, Artificial Sequence
  Synthetic
ccuuuuaguaguauuaggaa

SEQ ID NO: 19237 - RNA, 20 nt, Artificial Sequence
  Synthetic
aauuaagaaagacuccugaa

SEQ ID NO: 19238 - RNA, 20 nt, Artificial Sequence
  Synthetic
aguggccuuuaaacauugaa

SEQ ID NO: 19239 - RNA, 20 nt, Artificial Sequence
  Synthetic
aauguaguauuaaaccauaa

SEQ ID NO: 19240 - RNA, 20 nt, Artificial Sequence
  Synthetic
cuaaagcaaagagugcauaa

SEQ ID NO: 19241 - RNA, 20 nt, Artificial Sequence
  Synthetic
auaacccauuguguagauaa

SEQ ID NO: 19242 - RNA, 20 nt, Artificial Sequence
  Synthetic
ccuaaccuucauguugauaa

SEQ ID NO: 19243 - RNA, 20 nt, Artificial Sequence
  Synthetic
auuuugguguaguucuauaa

SEQ ID NO: 19244 - RNA, 20 nt, Artificial Sequence
  Synthetic
uuugaccuaagauauccuaa

SEQ ID NO: 19245 - RNA, 20 nt, Artificial Sequence
  Synthetic
cuaguauuagaaugggcuaa

SEQ ID NO: 19246 - RNA, 20 nt, Artificial Sequence
  Synthetic
uuggguaacaauaauauuaa

SEQ ID NO: 19247 - RNA, 20 nt, Artificial Sequence
  Synthetic
aauucaacuuuaucuguuaa

SEQ ID NO: 19248 - RNA, 20 nt, Artificial Sequence
  Synthetic
aguuagcaauggucuaaaca

SEQ ID NO: 19249 - RNA, 20 nt, Artificial Sequence
  Synthetic
augacaaucaaaugggaaca

SEQ ID NO: 19250 - RNA, 20 nt, Artificial Sequence
  Synthetic
agaaccuauaaggaauaaca

SEQ ID NO: 19251 - RNA, 20 nt, Artificial Sequence
  Synthetic
aguuuuaaacagaaguaaca

SEQ ID NO: 19252 - RNA, 20 nt, Artificial Sequence
  Synthetic
ugcauucccucauccaacca

SEQ ID NO: 19253 - RNA, 20 nt, Artificial Sequence
  Synthetic
uacuaaagacuucacccuca

SEQ ID NO: 19254 - RNA, 20 nt, Artificial Sequence
  Synthetic
cauaagccagcuuucaguca

SEQ ID NO: 19255 - RNA, 20 nt, Artificial Sequence
  Synthetic
uaaaucuaaaagcuaauuca

SEQ ID NO: 19256 - RNA, 20 nt, Artificial Sequence
  Synthetic
acgaauugguacaaauuuca

SEQ ID NO: 19257 - RNA, 20 nt, Artificial Sequence
  Synthetic
auaagauucuaaaggaaaga

SEQ ID NO: 19258 - RNA, 20 nt, Artificial Sequence
  Synthetic
aagucuaguuucaaggaaga

SEQ ID NO: 19259 - RNA, 20 nt, Artificial Sequence
  Synthetic
cccaacugaugucaagcaga

SEQ ID NO: 19260 - RNA, 20 nt, Artificial Sequence
  Synthetic
acugacuaaaacugaguaga

SEQ ID NO: 19261 - RNA, 20 nt, Artificial Sequence
  Synthetic
uggcuaccuugguuggauga

SEQ ID NO: 19262 - RNA, 20 nt, Artificial Sequence
  Synthetic
ccaguucaggcaagugauga

SEQ ID NO: 19263 - RNA, 20 nt, Artificial Sequence
  Synthetic
cuuaugaaaagcagcuauga

SEQ ID NO: 19264 - RNA, 20 nt, Artificial Sequence
  Synthetic
uuguuaaagaaugacuguga

SEQ ID NO: 19265 - RNA, 20 nt, Artificial Sequence
  Synthetic
agggucucucuaagguguga

SEQ ID NO: 19266 - RNA, 20 nt, Artificial Sequence
  Synthetic
aaccggugucuucugaaaua

SEQ ID NO: 19267 - RNA, 20 nt, Artificial Sequence
  Synthetic
aggaguauaucaaaagaaua

SEQ ID NO: 19268 - RNA, 20 nt, Artificial Sequence
  Synthetic
aguccucugugcuuugaaua

SEQ ID NO: 19269 - RNA, 20 nt, Artificial Sequence
  Synthetic
cccauaaauguugaauaaua

SEQ ID NO: 19270 - RNA, 20 nt, Artificial Sequence
  Synthetic
agccuagaugauuauuaaua

SEQ ID NO: 19271 - RNA, 20 nt, Artificial Sequence
  Synthetic
uauugaucauugccucacua

SEQ ID NO: 19272 - RNA, 20 nt, Artificial Sequence
  Synthetic
uaaagugcucguaaagacua

SEQ ID NO: 19273 - RNA, 20 nt, Artificial Sequence
  Synthetic
cuuugaccuaagauauccua

SEQ ID NO: 19274 - RNA, 20 nt, Artificial Sequence
  Synthetic
ugagccuaucaccuaggcua

SEQ ID NO: 19275 - RNA, 20 nt, Artificial Sequence
  Synthetic
aguaaucggcgguggaggua

SEQ ID NO: 19276 - RNA, 20 nt, Artificial Sequence
  Synthetic
uguuuuuaggcuauucugua

SEQ ID NO: 19277 - RNA, 20 nt, Artificial Sequence
  Synthetic
agcacucuauuuagagugua

SEQ ID NO: 19278 - RNA, 20 nt, Artificial Sequence
  Synthetic
uaagaagagaaaggggugua

SEQ ID NO: 19279 - RNA, 20 nt, Artificial Sequence
  Synthetic
caauuaguuuuaugccauua

SEQ ID NO: 19280 - RNA, 20 nt, Artificial Sequence
  Synthetic
uugcaggaggugagggauua

SEQ ID NO: 19281 - RNA, 20 nt, Artificial Sequence
  Synthetic
cuugacugaaagcuggcuua

SEQ ID NO: 19282 - RNA, 20 nt, Artificial Sequence
  Synthetic
cuuuaucaacaugaagguua

SEQ ID NO: 19283 - RNA, 20 nt, Artificial Sequence
  Synthetic
auucuaaguauuagagguua

SEQ ID NO: 19284 - RNA, 20 nt, Artificial Sequence
  Synthetic
ccccuauuauucaacauuua

SEQ ID NO: 19285 - RNA, 20 nt, Artificial Sequence
  Synthetic
uagucuuuacgagcacuuua

SEQ ID NO: 19286 - RNA, 20 nt, Artificial Sequence
  Synthetic
agaaagauaaugggagaaac

SEQ ID NO: 19287 - RNA, 20 nt, Artificial Sequence
  Synthetic
uacgauauaagaaaugaaac

SEQ ID NO: 19288 - RNA, 20 nt, Artificial Sequence
  Synthetic
uucguauguaggaaaacaac

SEQ ID NO: 19289 - RNA, 20 nt, Artificial Sequence
  Synthetic
cagaaccuauaaggaauaac

SEQ ID NO: 19290 - RNA, 20 nt, Artificial Sequence
  Synthetic
uagcuuauucuuguaauaac

SEQ ID NO: 19291 - RNA, 20 nt, Artificial Sequence
  Synthetic
augaaacuguuauaauuaac

SEQ ID NO: 19292 - RNA, 20 nt, Artificial Sequence
  Synthetic
cuccguauuucagaagacac

SEQ ID NO: 19293 - RNA, 20 nt, Artificial Sequence
  Synthetic
uaucauuucaacuuauacac

SEQ ID NO: 19294 - RNA, 20 nt, Artificial Sequence
  Synthetic
uuaguauuaaguauagccac

SEQ ID NO: 19295 - RNA, 20 nt, Artificial Sequence
  Synthetic
ugggugagauuagaggccac

SEQ ID NO: 19296 - RNA, 20 nt, Artificial Sequence
  Synthetic
ugauucuguuuaaauagcac

SEQ ID NO: 19297 - RNA, 20 nt, Artificial Sequence
  Synthetic
aguauagaauuuugcaucac

SEQ ID NO: 19298 - RNA, 20 nt, Artificial Sequence
  Synthetic
aggcuggcauagaguaagac

SEQ ID NO: 19299 - RNA, 20 nt, Artificial Sequence
  Synthetic
uacuguucuucaaaccagac

SEQ ID NO: 19300 - RNA, 20 nt, Artificial Sequence
  Synthetic
uguuacaacagucuuuauac

SEQ ID NO: 19301 - RNA, 20 nt, Artificial Sequence
  Synthetic
auugaugagcagauaauuac

SEQ ID NO: 19302 - RNA, 20 nt, Artificial Sequence
  Synthetic
uuacaaauuccaagacuuac

SEQ ID NO: 19303 - RNA, 20 nt, Artificial Sequence
  Synthetic
uacaaauauugacuauuuac

SEQ ID NO: 19304 - RNA, 20 nt, Artificial Sequence
  Synthetic
acccuaagaacaacuuaacc

SEQ ID NO: 19305 - RNA, 20 nt, Artificial Sequence
  Synthetic
auacuacuuccacuacuacc

SEQ ID NO: 19306 - RNA, 20 nt, Artificial Sequence
  Synthetic
acacuaacaccuacccuacc

SEQ ID NO: 19307 - RNA, 20 nt, Artificial Sequence
  Synthetic
agauacuaaaaaaaguuacc

SEQ ID NO: 19308 - RNA, 20 nt, Artificial Sequence
  Synthetic
ucuuuacugugaauggugcc

SEQ ID NO: 19309 - RNA, 20 nt, Artificial Sequence
  Synthetic
ccaaccaagguagccaaucc

SEQ ID NO: 19310 - RNA, 20 nt, Artificial Sequence
  Synthetic
caauauagcucugauaaucc

SEQ ID NO: 19311 - RNA, 20 nt, Artificial Sequence
  Synthetic
agugaaugaaugugguaucc

SEQ ID NO: 19312 - RNA, 20 nt, Artificial Sequence
  Synthetic
uguauuagcaaguggacucc

SEQ ID NO: 19313 - RNA, 20 nt, Artificial Sequence
  Synthetic
cuugacaucaguuggguucc

SEQ ID NO: 19314 - RNA, 20 nt, Artificial Sequence
  Synthetic
aguaaggaggucacugaggc

SEQ ID NO: 19315 - RNA, 20 nt, Artificial Sequence
  Synthetic
aguuucaaggaagagggggc

SEQ ID NO: 19316 - RNA, 20 nt, Artificial Sequence
  Synthetic
ugguagugugaagauggggc

SEQ ID NO: 19317 - RNA, 20 nt, Artificial Sequence
  Synthetic
uugguuggaugagggaaugc

SEQ ID NO: 19318 - RNA, 20 nt, Artificial Sequence
  Synthetic
uuuucauguuagacauaugc

SEQ ID NO: 19319 - RNA, 20 nt, Artificial Sequence
  Synthetic
agugcuauuuaaacagaauc

SEQ ID NO: 19320 - RNA, 20 nt, Artificial Sequence
  Synthetic
aaaagcugugcauuuuccuc

SEQ ID NO: 19321 - RNA, 20 nt, Artificial Sequence
  Synthetic
aagacuaaggcuuauuucuc

SEQ ID NO: 19322 - RNA, 20 nt, Artificial Sequence
  Synthetic
ugggacugacuauaccuguc

SEQ ID NO: 19323 - RNA, 20 nt, Artificial Sequence
  Synthetic
aauagagacaaggugguguc

SEQ ID NO: 19324 - RNA, 20 nt, Artificial Sequence
  Synthetic
cacucaauaaauuugguguc

SEQ ID NO: 19325 - RNA, 20 nt, Artificial Sequence
  Synthetic
uucuaacuuuucuuauuguc

SEQ ID NO: 19326 - RNA, 20 nt, Artificial Sequence
  Synthetic
aggaccaaaacuuuauuguc

SEQ ID NO: 19327 - RNA, 20 nt, Artificial Sequence
  Synthetic
cagcuggcuauccaggauuc

SEQ ID NO: 19328 - RNA, 20 nt, Artificial Sequence
  Synthetic
uauuaagaggaaaagacuuc

SEQ ID NO: 19329 - RNA, 20 nt, Artificial Sequence
  Synthetic
uacgaauugguacaaauuuc

SEQ ID NO: 19330 - RNA, 20 nt, Artificial Sequence
  Synthetic
cuuacuggcaauuaaauuuc

SEQ ID NO: 19331 - RNA, 20 nt, Artificial Sequence
  Synthetic
uugauaaauaauugccuuuc

SEQ ID NO: 19332 - RNA, 20 nt, Artificial Sequence
  Synthetic
ccuaaaaacauuagccaaag

SEQ ID NO: 19333 - RNA, 20 nt, Artificial Sequence
  Synthetic
uaggauaucuuaggucaaag

SEQ ID NO: 19334 - RNA, 20 nt, Artificial Sequence
  Synthetic
uagggugggauauggagaag

SEQ ID NO: 19335 - RNA, 20 nt, Artificial Sequence
  Synthetic
caagucuaguuucaaggaag

SEQ ID NO: 19336 - RNA, 20 nt, Artificial Sequence
  Synthetic
uuuccauauucaaagcacag

SEQ ID NO: 19337 - RNA, 20 nt, Artificial Sequence
  Synthetic
acagcuaaaguauuacccag

SEQ ID NO: 19338 - RNA, 20 nt, Artificial Sequence
  Synthetic
agucuauauuuguuuuccag

SEQ ID NO: 19339 - RNA, 20 nt, Artificial Sequence
  Synthetic
ugcuauuuaaacagaaucag

SEQ ID NO: 19340 - RNA, 20 nt, Artificial Sequence
  Synthetic
auauuguuacauaaaaagag

SEQ ID NO: 19341 - RNA, 20 nt, Artificial Sequence
  Synthetic
agucuaguuucaaggaagag

SEQ ID NO: 19342 - RNA, 20 nt, Artificial Sequence
  Synthetic
aauuaccaaauuguauugag

SEQ ID NO: 19343 - RNA, 20 nt, Artificial Sequence
  Synthetic
cugacaccaaauuuauugag

SEQ ID NO: 19344 - RNA, 20 nt, Artificial Sequence
  Synthetic
ccauaaauguugaauaauag

SEQ ID NO: 19345 - RNA, 20 nt, Artificial Sequence
  Synthetic
uggaaaguuguccaagauag

SEQ ID NO: 19346 - RNA, 20 nt, Artificial Sequence
  Synthetic
acuuuuccgugcaucacuag

SEQ ID NO: 19347 - RNA, 20 nt, Artificial Sequence
  Synthetic
uggcuugauccagguaguag

SEQ ID NO: 19348 - RNA, 20 nt, Artificial Sequence
  Synthetic
auuucucugggugagauuag

SEQ ID NO: 19349 - RNA, 20 nt, Artificial Sequence
  Synthetic
aagggcauucuaaguauuag

SEQ ID NO: 19350 - RNA, 20 nt, Artificial Sequence
  Synthetic
agcuaugaaggcagaguuag

SEQ ID NO: 19351 - RNA, 20 nt, Artificial Sequence
  Synthetic
uuuaucaacaugaagguuag

SEQ ID NO: 19352 - RNA, 20 nt, Artificial Sequence
  Synthetic
auaaaaucagugcuuuuucg

SEQ ID NO: 19353 - RNA, 20 nt, Artificial Sequence
  Synthetic
cuaaguauuagagguuaagg

SEQ ID NO: 19354 - RNA, 20 nt, Artificial Sequence
  Synthetic
cauuucaacuuauacacagg

SEQ ID NO: 19355 - RNA, 20 nt, Artificial Sequence
  Synthetic
uuguuacauaaaaagagagg

SEQ ID NO: 19356 - RNA, 20 nt, Artificial Sequence
  Synthetic
aguauuagagguuaaggagg

SEQ ID NO: 19357 - RNA, 20 nt, Artificial Sequence
  Synthetic
uaaucggcgguggagguagg

SEQ ID NO: 19358 - RNA, 20 nt, Artificial Sequence
  Synthetic
acugucagagaaguaaucgg

SEQ ID NO: 19359 - RNA, 20 nt, Artificial Sequence
  Synthetic
auucuguagggagacaaggg

SEQ ID NO: 19360 - RNA, 20 nt, Artificial Sequence
  Synthetic
uggcauagaguaagacaggg

SEQ ID NO: 19361 - RNA, 20 nt, Artificial Sequence
  Synthetic
agguuaaguuguucuuaggg

SEQ ID NO: 19362 - RNA, 20 nt, Artificial Sequence
  Synthetic
uucaggagccaaaaauuggg

SEQ ID NO: 19363 - RNA, 20 nt, Artificial Sequence
  Synthetic
agagaaguaaucggcggugg

SEQ ID NO: 19364 - RNA, 20 nt, Artificial Sequence
  Synthetic
aggagccaaaaauugggugg

SEQ ID NO: 19365 - RNA, 20 nt, Artificial Sequence
  Synthetic
acaaagcuagugaaugaaug

SEQ ID NO: 19366 - RNA, 20 nt, Artificial Sequence
  Synthetic
auuuaucaauaucuaagaug

SEQ ID NO: 19367 - RNA, 20 nt, Artificial Sequence
  Synthetic
uuggcuaccuugguuggaug

SEQ ID NO: 19368 - RNA, 20 nt, Artificial Sequence
  Synthetic
ccuauuauucaacauuuaug

SEQ ID NO: 19369 - RNA, 20 nt, Artificial Sequence
  Synthetic
cacgaauauauucuuuuaug

SEQ ID NO: 19370 - RNA, 20 nt, Artificial Sequence
  Synthetic
uuugauugucauuuuagcug

SEQ ID NO: 19371 - RNA, 20 nt, Artificial Sequence
  Synthetic
aucaucuguuaguaaugcug

SEQ ID NO: 19372 - RNA, 20 nt, Artificial Sequence
  Synthetic
uuuuuaagggcauagcucug

SEQ ID NO: 19373 - RNA, 20 nt, Artificial Sequence
  Synthetic
aaggaaaugggguauaagug

SEQ ID NO: 19374 - RNA, 20 nt, Artificial Sequence
  Synthetic
uaaaacucaguaccauagug

SEQ ID NO: 19375 - RNA, 20 nt, Artificial Sequence
  Synthetic
caggagccaaaaauugggug

SEQ ID NO: 19376 - RNA, 20 nt, Artificial Sequence
  Synthetic
caucuguuaguaaugcugug

SEQ ID NO: 19377 - RNA, 20 nt, Artificial Sequence
  Synthetic
uauggcaucucaccagugug

SEQ ID NO: 19378 - RNA, 20 nt, Artificial Sequence
  Synthetic
uggcaucucaccagugugug

SEQ ID NO: 19379 - RNA, 20 nt, Artificial Sequence
  Synthetic
uacgguaagcucaagcauug

SEQ ID NO: 19380 - RNA, 20 nt, Artificial Sequence
  Synthetic
uugguauuuaccauauauug

SEQ ID NO: 19381 - RNA, 20 nt, Artificial Sequence
  Synthetic
uugcucucuuuuaacuauug

SEQ ID NO: 19382 - RNA, 20 nt, Artificial Sequence
  Synthetic
uauugaguggaaauuuuuug

SEQ ID NO: 19383 - RNA, 20 nt, Artificial Sequence
  Synthetic
ugcuuucaggagccaaaaau

SEQ ID NO: 19384 - RNA, 20 nt, Artificial Sequence
  Synthetic
agcuaaaaugacaaucaaau

SEQ ID NO: 19385 - RNA, 20 nt, Artificial Sequence
  Synthetic
agaaugggcuaaagggcaau

SEQ ID NO: 19386 - RNA, 20 nt, Artificial Sequence
  Synthetic
uguauggcaugaguacgaau

SEQ ID NO: 19387 - RNA, 20 nt, Artificial Sequence
  Synthetic
ccguuuacuagaaagauaau

SEQ ID NO: 19388 - RNA, 20 nt, Artificial Sequence
  Synthetic
aauacugucagagaaguaau

SEQ ID NO: 19389 - RNA, 20 nt, Artificial Sequence
  Synthetic
cagccuagaugauuauuaau

SEQ ID NO: 19390 - RNA, 20 nt, Artificial Sequence
  Synthetic
caagugcaaagcuuucagau

SEQ ID NO: 19391 - RNA, 20 nt, Artificial Sequence
  Synthetic
cuaaaaaaaguuaccuggau

SEQ ID NO: 19392 - RNA, 20 nt, Artificial Sequence
  Synthetic
ucuuuguguuaacaaaauau

SEQ ID NO: 19393 - RNA, 20 nt, Artificial Sequence
  Synthetic
aacuuauccauuaauccuau

SEQ ID NO: 19394 - RNA, 20 nt, Artificial Sequence
  Synthetic
acaaaugcuugaccacuuau

SEQ ID NO: 19395 - RNA, 20 nt, Artificial Sequence
  Synthetic
cccuauuauucaacauuuau

SEQ ID NO: 19396 - RNA, 20 nt, Artificial Sequence
  Synthetic
uucuuuaacaaaccuuuuau

SEQ ID NO: 19397 - RNA, 20 nt, Artificial Sequence
  Synthetic
agcuuauucuuguaauaacu

SEQ ID NO: 19398 - RNA, 20 nt, Artificial Sequence
  Synthetic
cacuugcuucaccugcuacu

SEQ ID NO: 19399 - RNA, 20 nt, Artificial Sequence
  Synthetic
aaaaucuuauagagauuacu

SEQ ID NO: 19400 - RNA, 20 nt, Artificial Sequence
  Synthetic
uuuuuuugagccuaucaccu

SEQ ID NO: 19401 - RNA, 20 nt, Artificial Sequence
  Synthetic
agaggaaggcaguggucccu

SEQ ID NO: 19402 - RNA, 20 nt, Artificial Sequence
  Synthetic
aggcacuuguugacaguccu

SEQ ID NO: 19403 - RNA, 20 nt, Artificial Sequence
  Synthetic
aacagguuuuggauggagcu

SEQ ID NO: 19404 - RNA, 20 nt, Artificial Sequence
  Synthetic
aaaacucauaagggaccgcu

SEQ ID NO: 19405 - RNA, 20 nt, Artificial Sequence
  Synthetic
aauaaauuuggugucaggcu

SEQ ID NO: 19406 - RNA, 20 nt, Artificial Sequence
  Synthetic
uugagccuaucaccuaggcu

SEQ ID NO: 19407 - RNA, 20 nt, Artificial Sequence
  Synthetic
uucaaauuauuucuacugcu

SEQ ID NO: 19408 - RNA, 20 nt, Artificial Sequence
  Synthetic
uaauauaccugucaagugcu

SEQ ID NO: 19409 - RNA, 20 nt, Artificial Sequence
  Synthetic
uccccuauuaauaaucaucu

SEQ ID NO: 19410 - RNA, 20 nt, Artificial Sequence
  Synthetic
ucuugcuuuucccacuaucu

SEQ ID NO: 19411 - RNA, 20 nt, Artificial Sequence
  Synthetic
agacuaaggcuuauuucucu

SEQ ID NO: 19412 - RNA, 20 nt, Artificial Sequence
  Synthetic
auuuaauugccaguaagucu

SEQ ID NO: 19413 - RNA, 20 nt, Artificial Sequence
  Synthetic
aauaauuugaacaacauucu

SEQ ID NO: 19414 - RNA, 20 nt, Artificial Sequence
  Synthetic
uaugugaaaauaucacuucu

SEQ ID NO: 19415 - RNA, 20 nt, Artificial Sequence
  Synthetic
cccuucugcuugacaucagu

SEQ ID NO: 19416 - RNA, 20 nt, Artificial Sequence
  Synthetic
agucaguuuuauuuuucagu

SEQ ID NO: 19417 - RNA, 20 nt, Artificial Sequence
  Synthetic
uguacauuuuccuaaugagu

SEQ ID NO: 19418 - RNA, 20 nt, Artificial Sequence
  Synthetic
auuaccaaauuguauugagu

SEQ ID NO: 19419 - RNA, 20 nt, Artificial Sequence
  Synthetic
aguaguggaaguaguauagu

SEQ ID NO: 19420 - RNA, 20 nt, Artificial Sequence
  Synthetic
uacugugaauggugccaggu

SEQ ID NO: 19421 - RNA, 20 nt, Artificial Sequence
  Synthetic
uguuacauaaaaagagaggu

SEQ ID NO: 19422 - RNA, 20 nt, Artificial Sequence
  Synthetic
aaguaaucggcgguggaggu

SEQ ID NO: 19423 - RNA, 20 nt, Artificial Sequence
  Synthetic
ucaggagccaaaaauugggu

SEQ ID NO: 19424 - RNA, 20 nt, Artificial Sequence
  Synthetic
ccuggauuggcuaccuuggu

SEQ ID NO: 19425 - RNA, 20 nt, Artificial Sequence
  Synthetic
uuaaaagcuguuucguaugu

SEQ ID NO: 19426 - RNA, 20 nt, Artificial Sequence
  Synthetic
ucaucuguuaguaaugcugu

SEQ ID NO: 19427 - RNA, 20 nt, Artificial Sequence
  Synthetic
auguuuuuaggcuauucugu

SEQ ID NO: 19428 - RNA, 20 nt, Artificial Sequence
  Synthetic
auggcaucucaccagugugu

SEQ ID NO: 19429 - RNA, 20 nt, Artificial Sequence
  Synthetic
cuuacccacucaauacaauu

SEQ ID NO: 19430 - RNA, 20 nt, Artificial Sequence
  Synthetic
aaaaauaucaccaacucauu

SEQ ID NO: 19431 - RNA, 20 nt, Artificial Sequence
  Synthetic
aagaucucugcaaacauauu

SEQ ID NO: 19432 - RNA, 20 nt, Artificial Sequence
  Synthetic
acaacuuaaccuggcauauu

SEQ ID NO: 19433 - RNA, 20 nt, Artificial Sequence
  Synthetic
auccaacuaacaucucuauu

SEQ ID NO: 19434 - RNA, 20 nt, Artificial Sequence
  Synthetic
caucaaugguugucuguauu

SEQ ID NO: 19435 - RNA, 20 nt, Artificial Sequence
  Synthetic
cagaaguaacagggccacuu

SEQ ID NO: 19436 - RNA, 20 nt, Artificial Sequence
  Synthetic
auagauuagcuuauauacuu

SEQ ID NO: 19437 - RNA, 20 nt, Artificial Sequence
  Synthetic
cuaauacuuagaaugcccuu

SEQ ID NO: 19438 - RNA, 20 nt, Artificial Sequence
  Synthetic
uagaugugcaaaaauagcuu

SEQ ID NO: 19439 - RNA, 20 nt, Artificial Sequence
  Synthetic
ugccagguuaaguuguucuu

SEQ ID NO: 19440 - RNA, 20 nt, Artificial Sequence
  Synthetic
ccuucugcuugacaucaguu

SEQ ID NO: 19441 - RNA, 20 nt, Artificial Sequence
  Synthetic
ccuuuaucaacaugaagguu

SEQ ID NO: 19442 - RNA, 20 nt, Artificial Sequence
  Synthetic
aucagugcuuuuucgagguu

SEQ ID NO: 19443 - RNA, 20 nt, Artificial Sequence
  Synthetic
uaauucauggaaagcuuguu

SEQ ID NO: 19444 - RNA, 20 nt, Artificial Sequence
  Synthetic
cauuuguguacuugugauuu

SEQ ID NO: 19445 - RNA, 20 nt, Artificial Sequence
  Synthetic
agaucucugcaaacauauuu

SEQ ID NO: 19446 - RNA, 20 nt, Artificial Sequence
  Synthetic
cuuuaugcacucuuugcuuu

SEQ ID NO: 19447 - RNA, 20 nt, Artificial Sequence
  Synthetic
uucuccugacaauaaaguuu

SEQ ID NO: 19448 - RNA, 20 nt, Artificial Sequence
  Synthetic
auaaugggagaaacagguuu

SEQ ID NO: 19449 - RNA, 20 nt, Artificial Sequence
  Synthetic
uuuuggauggagcuugguuu

SEQ ID NO: 19450 - RNA, 20 nt, Artificial Sequence
  Synthetic
aucagagcuauauuguguuu

SEQ ID NO: 19451 - RNA, 20 nt, Artificial Sequence
  Synthetic
ccacuuuggcuaauguuuuu

SEQ ID NO: 19452 - RNA, 17 nt, Artificial Sequence
  Synthetic
gaccaucccggcuaaaa

SEQ ID NO: 19453 - RNA, 17 nt, Artificial Sequence
  Synthetic
guugauaagaagagaaa

SEQ ID NO: 19454 - RNA, 17 nt, Artificial Sequence
  Synthetic
gauguuuauuuaugaaa

SEQ ID NO: 19455 - RNA, 17 nt, Artificial Sequence
  Synthetic
guuauucagccaauaaa

SEQ ID NO: 19456 - RNA, 17 nt, Artificial Sequence
  Synthetic
gguuuaauuuuguacaa

SEQ ID NO: 19457 - RNA, 17 nt, Artificial Sequence
  Synthetic
gacuaaucaccucccaa

SEQ ID NO: 19458 - RNA, 17 nt, Artificial Sequence
  Synthetic
guucucacauggcagaa

SEQ ID NO: 19459 - RNA, 17 nt, Artificial Sequence
  Synthetic
gguugauaagaagagaa

SEQ ID NO: 19460 - RNA, 17 nt, Artificial Sequence
  Synthetic
gagggaaugcaggagaa

SEQ ID NO: 19461 - RNA, 17 nt, Artificial Sequence
  Synthetic
gggaggcugaagcggaa

SEQ ID NO: 19462 - RNA, 17 nt, Artificial Sequence
  Synthetic
ggauuucaacauaugaa

SEQ ID NO: 19463 - RNA, 17 nt, Artificial Sequence
  Synthetic
gguaacaauaauauuaa

SEQ ID NO: 19464 - RNA, 17 nt, Artificial Sequence
  Synthetic
gaccagcgugggcaaca

SEQ ID NO: 19465 - RNA, 17 nt, Artificial Sequence
  Synthetic
guacaguggugcaauca

SEQ ID NO: 19466 - RNA, 17 nt, Artificial Sequence
  Synthetic
gaaggaaggaaguaaga

SEQ ID NO: 19467 - RNA, 17 nt, Artificial Sequence
  Synthetic
gaaagcaauaguagaga

SEQ ID NO: 19468 - RNA, 17 nt, Artificial Sequence
  Synthetic
guaggaggaaggaagga

SEQ ID NO: 19469 - RNA, 17 nt, Artificial Sequence
  Synthetic
ggaaguaggaggaagga

SEQ ID NO: 19470 - RNA, 17 nt, Artificial Sequence
  Synthetic
gaaaaagaaagagagga

SEQ ID NO: 19471 - RNA, 17 nt, Artificial Sequence
  Synthetic
gaaaggaaguaggagga

SEQ ID NO: 19472 - RNA, 17 nt, Artificial Sequence
  Synthetic
gucccagcuacuuggga

SEQ ID NO: 19473 - RNA, 17 nt, Artificial Sequence
  Synthetic
guauucuaucauaugga

SEQ ID NO: 19474 - RNA, 17 nt, Artificial Sequence
  Synthetic
gagaaacagguuuugga

SEQ ID NO: 19475 - RNA, 17 nt, Artificial Sequence
  Synthetic
guucaggcaagugauga

SEQ ID NO: 19476 - RNA, 17 nt, Artificial Sequence
  Synthetic
gggugagggucucucua

SEQ ID NO: 19477 - RNA, 17 nt, Artificial Sequence
  Synthetic
gugaauggugccaggua

SEQ ID NO: 19478 - RNA, 17 nt, Artificial Sequence
  Synthetic
gaagagaaaggggugua

SEQ ID NO: 19479 - RNA, 17 nt, Artificial Sequence
  Synthetic
gaaaaaaaauucaaaac

SEQ ID NO: 19480 - RNA, 17 nt, Artificial Sequence
  Synthetic
gauauaagaaaugaaac

SEQ ID NO: 19481 - RNA, 17 nt, Artificial Sequence
  Synthetic
guauuuuuaguagagac

SEQ ID NO: 19482 - RNA, 17 nt, Artificial Sequence
  Synthetic
ggagaauggcgugaacc

SEQ ID NO: 19483 - RNA, 17 nt, Artificial Sequence
  Synthetic
gagaauggcgugaaccc

SEQ ID NO: 19484 - RNA, 17 nt, Artificial Sequence
  Synthetic
gucucacucugucaccc

SEQ ID NO: 19485 - RNA, 17 nt, Artificial Sequence
  Synthetic
gucuuacucugucaccc

SEQ ID NO: 19486 - RNA, 17 nt, Artificial Sequence
  Synthetic
gagaauugcuugagccc

SEQ ID NO: 19487 - RNA, 17 nt, Artificial Sequence
  Synthetic
gucucgcucugucgccc

SEQ ID NO: 19488 - RNA, 17 nt, Artificial Sequence
  Synthetic
gccacugcacuccagcc

SEQ ID NO: 19489 - RNA, 17 nt, Artificial Sequence
  Synthetic
ggagaauugcuugagcc

SEQ ID NO: 19490 - RNA, 17 nt, Artificial Sequence
  Synthetic
gccacugcacucuagcc

SEQ ID NO: 19491 - RNA, 17 nt, Artificial Sequence
  Synthetic
guuucacuguguuagcc

SEQ ID NO: 19492 - RNA, 17 nt, Artificial Sequence
  Synthetic
guuucaccguuuuagcc

SEQ ID NO: 19493 - RNA, 17 nt, Artificial Sequence
  Synthetic
gcgcccgccacuacgcc

SEQ ID NO: 19494 - RNA, 17 nt, Artificial Sequence
  Synthetic
gcgugagccaccgcgcc

SEQ ID NO: 19495 - RNA, 17 nt, Artificial Sequence
  Synthetic
guuucaccauguuggcc

SEQ ID NO: 19496 - RNA, 17 nt, Artificial Sequence
  Synthetic
ggagaucaagaccaucc

SEQ ID NO: 19497 - RNA, 17 nt, Artificial Sequence
  Synthetic
ggagaucgagaccaucc

SEQ ID NO: 19498 - RNA, 17 nt, Artificial Sequence
  Synthetic
gugaauugcuugagucc

SEQ ID NO: 19499 - RNA, 17 nt, Artificial Sequence
  Synthetic
gguuucaccguuuuagc

SEQ ID NO: 19500 - RNA, 17 nt, Artificial Sequence
  Synthetic
ggcuggagugcaguggc

SEQ ID NO: 19501 - RNA, 17 nt, Artificial Sequence
  Synthetic
gcacccgccaucacguc

SEQ ID NO: 19502 - RNA, 17 nt, Artificial Sequence
  Synthetic
gggcggaucacgagguc

SEQ ID NO: 19503 - RNA, 17 nt, Artificial Sequence
  Synthetic
gcaugagccacuguguc

SEQ ID NO: 19504 - RNA, 17 nt, Artificial Sequence
  Synthetic
ggugggauauggagaag

SEQ ID NO: 19505 - RNA, 17 nt, Artificial Sequence
  Synthetic
guaauagcaacaggaag

SEQ ID NO: 19506 - RNA, 17 nt, Artificial Sequence
  Synthetic
gauuuuugacuauacag

SEQ ID NO: 19507 - RNA, 17 nt, Artificial Sequence
  Synthetic
gaguuagaggaaggcag

SEQ ID NO: 19508 - RNA, 17 nt, Artificial Sequence
  Synthetic
guuuguguuuuuuguag

SEQ ID NO: 19509 - RNA, 17 nt, Artificial Sequence
  Synthetic
gaggcgggcggaucacg

SEQ ID NO: 19510 - RNA, 17 nt, Artificial Sequence
  Synthetic
gagucaaaaauuauacg

SEQ ID NO: 19511 - RNA, 17 nt, Artificial Sequence
  Synthetic
ggaguuugagaccagcg

SEQ ID NO: 19512 - RNA, 17 nt, Artificial Sequence
  Synthetic
gaacaaagacuugcagg

SEQ ID NO: 19513 - RNA, 17 nt, Artificial Sequence
  Synthetic
ggcgugaacccgggagg

SEQ ID NO: 19514 - RNA, 17 nt, Artificial Sequence
  Synthetic
ggaagaaaggaaguagg

SEQ ID NO: 19515 - RNA, 17 nt, Artificial Sequence
  Synthetic
gugaugguauugcaggg

SEQ ID NO: 19516 - RNA, 17 nt, Artificial Sequence
  Synthetic
gaagaaagaaggaaaug

SEQ ID NO: 19517 - RNA, 17 nt, Artificial Sequence
  Synthetic
gaggugauuaguccaug

SEQ ID NO: 19518 - RNA, 17 nt, Artificial Sequence
  Synthetic
gaggcaggcagaucaug

SEQ ID NO: 19519 - RNA, 17 nt, Artificial Sequence
  Synthetic
gaauauauucuuuuaug

SEQ ID NO: 19520 - RNA, 17 nt, Artificial Sequence
  Synthetic
guagcaaaugauaaaau

SEQ ID NO: 19521 - RNA, 17 nt, Artificial Sequence
  Synthetic
guuuacuaacucaaucu

SEQ ID NO: 19522 - RNA, 17 nt, Artificial Sequence
  Synthetic
gugcaguggcgcgaucu

SEQ ID NO: 19523 - RNA, 17 nt, Artificial Sequence
  Synthetic
gcacaguggugcgaucu

SEQ ID NO: 19524 - RNA, 17 nt, Artificial Sequence
  Synthetic
gugcaguggcgggaucu

SEQ ID NO: 19525 - RNA, 17 nt, Artificial Sequence
  Synthetic
gcugugcauuuuccucu

SEQ ID NO: 19526 - RNA, 17 nt, Artificial Sequence
  Synthetic
gaguuugagaccagcgu

SEQ ID NO: 19527 - RNA, 17 nt, Artificial Sequence
  Synthetic
guguuuuuuguagaggu

SEQ ID NO: 19528 - RNA, 17 nt, Artificial Sequence
  Synthetic
guacuacuguaauaauu

SEQ ID NO: 19529 - RNA, 17 nt, Artificial Sequence
  Synthetic
gcaggaggugagggauu

SEQ ID NO: 19530 - RNA, 17 nt, Artificial Sequence
  Synthetic
guuaucucugaaauuuu

SEQ ID NO: 19531 - RNA, 20 nt, Artificial Sequence
  Synthetic
gaaugcaggagaauggaaaa

SEQ ID NO: 19532 - RNA, 20 nt, Artificial Sequence
  Synthetic
guguucucacauggcagaaa

SEQ ID NO: 19533 - RNA, 20 nt, Artificial Sequence
  Synthetic
gcaucacgugguguuuuaaa

SEQ ID NO: 19534 - RNA, 20 nt, Artificial Sequence
  Synthetic
gggaggcugaggcaggagaa

SEQ ID NO: 19535 - RNA, 20 nt, Artificial Sequence
  Synthetic
gaugagggaaugcaggagaa

SEQ ID NO: 19536 - RNA, 20 nt, Artificial Sequence
  Synthetic
gggagacaagggaggaagca

SEQ ID NO: 19537 - RNA, 20 nt, Artificial Sequence
  Synthetic
ggcugggaaguccaagauca

SEQ ID NO: 19538 - RNA, 20 nt, Artificial Sequence
  Synthetic
gaaguaggaggaaggaagga

SEQ ID NO: 19539 - RNA, 20 nt, Artificial Sequence
  Synthetic
gaagaaaggaaguaggagga

SEQ ID NO: 19540 - RNA, 20 nt, Artificial Sequence
  Synthetic
guagucccagcuacuuggga

SEQ ID NO: 19541 - RNA, 20 nt, Artificial Sequence
  Synthetic
gggaggugauuaguccauga

SEQ ID NO: 19542 - RNA, 20 nt, Artificial Sequence
  Synthetic
gacuguuuauguuaucugua

SEQ ID NO: 19543 - RNA, 20 nt, Artificial Sequence
  Synthetic
gccacuuccuguugcuauua

SEQ ID NO: 19544 - RNA, 20 nt, Artificial Sequence
  Synthetic
guguguauauguguguauua

SEQ ID NO: 19545 - RNA, 20 nt, Artificial Sequence
  Synthetic
guucaagccuguauuguuua

SEQ ID NO: 19546 - RNA, 20 nt, Artificial Sequence
  Synthetic
gagcuuaccguaauagcaac

SEQ ID NO: 19547 - RNA, 20 nt, Artificial Sequence
  Synthetic
gcaggagaauggcgugaacc

SEQ ID NO: 19548 - RNA, 20 nt, Artificial Sequence
  Synthetic
gcauauauauauuuuuaacc

SEQ ID NO: 19549 - RNA, 20 nt, Artificial Sequence
  Synthetic
gacagagucuuacugucacc

SEQ ID NO: 19550 - RNA, 20 nt, Artificial Sequence
  Synthetic
ggagucucgcucugucgccc

SEQ ID NO: 19551 - RNA, 20 nt, Artificial Sequence
  Synthetic
gcaggagaauugcuugagcc

SEQ ID NO: 19552 - RNA, 20 nt, Artificial Sequence
  Synthetic
ggaguuucacuguguuagcc

SEQ ID NO: 19553 - RNA, 20 nt, Artificial Sequence
  Synthetic
gggguuucaccguuuuagcc

SEQ ID NO: 19554 - RNA, 20 nt, Artificial Sequence
  Synthetic
gggguuucaccauguuggcc

SEQ ID NO: 19555 - RNA, 20 nt, Artificial Sequence
  Synthetic
gauguaucuccaaauaugcc

SEQ ID NO: 19556 - RNA, 20 nt, Artificial Sequence
  Synthetic
ggaugcccuugacugaaagc

SEQ ID NO: 19557 - RNA, 20 nt, Artificial Sequence
  Synthetic
gaacacagcaggaagacagc

SEQ ID NO: 19558 - RNA, 20 nt, Artificial Sequence
  Synthetic
gccucacccucccaaguagc

SEQ ID NO: 19559 - RNA, 20 nt, Artificial Sequence
  Synthetic
gccucagccucccaaguagc

SEQ ID NO: 19560 - RNA, 20 nt, Artificial Sequence
  Synthetic
ggaagagucuuccaaguagc

SEQ ID NO: 19561 - RNA, 20 nt, Artificial Sequence
  Synthetic
gccucagccucccgaguagc

SEQ ID NO: 19562 - RNA, 20 nt, Artificial Sequence
  Synthetic
guuugccauguugcccacgc

SEQ ID NO: 19563 - RNA, 20 nt, Artificial Sequence
  Synthetic
gagucuuacugucaccaggc

SEQ ID NO: 19564 - RNA, 20 nt, Artificial Sequence
  Synthetic
gcacuuuuggaggcagaggc

SEQ ID NO: 19565 - RNA, 20 nt, Artificial Sequence
  Synthetic
gcacuuugggaggccgaggc

SEQ ID NO: 19566 - RNA, 20 nt, Artificial Sequence
  Synthetic
gcuacucgggaggcugaggc

SEQ ID NO: 19567 - RNA, 20 nt, Artificial Sequence
  Synthetic
gcuacuugggaggcugaggc

SEQ ID NO: 19568 - RNA, 20 nt, Artificial Sequence
  Synthetic
gcuacuugggagggugaggc

SEQ ID NO: 19569 - RNA, 20 nt, Artificial Sequence
  Synthetic
gauuucaacauaugaauggc

SEQ ID NO: 19570 - RNA, 20 nt, Artificial Sequence
  Synthetic
gugcaagacuucacaccugc

SEQ ID NO: 19571 - RNA, 20 nt, Artificial Sequence
  Synthetic
gcuucagccucccaaagugc

SEQ ID NO: 19572 - RNA, 20 nt, Artificial Sequence
  Synthetic
gccucggccucccaaagugc

SEQ ID NO: 19573 - RNA, 20 nt, Artificial Sequence
  Synthetic
gcccguagucccagcuacuc

SEQ ID NO: 19574 - RNA, 20 nt, Artificial Sequence
  Synthetic
ggcgggcggaucacgagguc

SEQ ID NO: 19575 - RNA, 20 nt, Artificial Sequence
  Synthetic
gaauuuauuucucacaguuc

SEQ ID NO: 19576 - RNA, 20 nt, Artificial Sequence
  Synthetic
guguguguguguccuuguuc

SEQ ID NO: 19577 - RNA, 20 nt, Artificial Sequence
  Synthetic
ggguugauaagaagagaaag

SEQ ID NO: 19578 - RNA, 20 nt, Artificial Sequence
  Synthetic
gaucaccugagccugagaag

SEQ ID NO: 19579 - RNA, 20 nt, Artificial Sequence
  Synthetic
gaaagaaggaaggaaguaag

SEQ ID NO: 19580 - RNA, 20 nt, Artificial Sequence
  Synthetic
gucaccaggcuggagcacag

SEQ ID NO: 19581 - RNA, 20 nt, Artificial Sequence
  Synthetic
guggauuuuugacuauacag

SEQ ID NO: 19582 - RNA, 20 nt, Artificial Sequence
  Synthetic
gcagaguuagaggaaggcag

SEQ ID NO: 19583 - RNA, 20 nt, Artificial Sequence
  Synthetic
gccgaggcgggcggaucacg

SEQ ID NO: 19584 - RNA, 20 nt, Artificial Sequence
  Synthetic
guggagucaaaaauuauacg

SEQ ID NO: 19585 - RNA, 20 nt, Artificial Sequence
  Synthetic
gaaaugaaacaggccgggcg

SEQ ID NO: 19586 - RNA, 20 nt, Artificial Sequence
  Synthetic
gagaauggcgugaacccagg

SEQ ID NO: 19587 - RNA, 20 nt, Artificial Sequence
  Synthetic
guuuguguuuuuuguagagg

SEQ ID NO: 19588 - RNA, 20 nt, Artificial Sequence
  Synthetic
gagaauggcgugaacccggg

SEQ ID NO: 19589 - RNA, 20 nt, Artificial Sequence
  Synthetic
gagaauugcuugagcccggg

SEQ ID NO: 19590 - RNA, 20 nt, Artificial Sequence
  Synthetic
guucaggcaagugaugaugg

SEQ ID NO: 19591 - RNA, 20 nt, Artificial Sequence
  Synthetic
gccgaggcaggcagaucaug

SEQ ID NO: 19592 - RNA, 20 nt, Artificial Sequence
  Synthetic
gaacaguaaggaggucacug

SEQ ID NO: 19593 - RNA, 20 nt, Artificial Sequence
  Synthetic
ggugaugguauugcagggug

SEQ ID NO: 19594 - RNA, 20 nt, Artificial Sequence
  Synthetic
ggcucaaaaaaaaaaaaaau

SEQ ID NO: 19595 - RNA, 20 nt, Artificial Sequence
  Synthetic
gcaccacuguacccuagccu

SEQ ID NO: 19596 - RNA, 20 nt, Artificial Sequence
  Synthetic
gcgccacugcacucuagccu

SEQ ID NO: 19597 - RNA, 20 nt, Artificial Sequence
  Synthetic
ggagcacaguggugcgaucu

SEQ ID NO: 19598 - RNA, 20 nt, Artificial Sequence
  Synthetic
ggagugcaguggcgggaucu

SEQ ID NO: 19599 - RNA, 20 nt, Artificial Sequence
  Synthetic
gcuacuugggaggcugaggu

SEQ ID NO: 19600 - RNA, 20 nt, Artificial Sequence
  Synthetic
gguuaaguuguucuuagggu

SEQ ID NO: 19601 - RNA, 20 nt, Artificial Sequence
  Synthetic
gagacgggguuucaccaugu

SEQ ID NO: 19602 - RNA, 20 nt, Artificial Sequence
  Synthetic
gccucggccucccaaagugu

SEQ ID NO: 19603 - RNA, 20 nt, Artificial Sequence
  Synthetic
gcaaugcuaauaauacaauu

SEQ ID NO: 19604 - RNA, 20 nt, Artificial Sequence
  Synthetic
gaucaaggugccagcagauu

SEQ ID NO: 19605 - RNA, 20 nt, Artificial Sequence
  Synthetic
guuuccaaauuuuuuuuauu

SEQ ID NO: 19606 - RNA, 20 nt, Artificial Sequence
  Synthetic
gccuguagucccagcuacuu

SEQ ID NO: 19607 - RNA, 20 nt, Artificial Sequence
  Synthetic
guauugcaggguggggccuu

SEQ ID NO: 19608 - RNA, 20 nt, Artificial Sequence
  Synthetic
gccuguaaucccaacacuuu

SEQ ID NO: 19609 - RNA, 20 nt, Artificial Sequence
  Synthetic
gccuauaaacccagcacuuu

SEQ ID NO: 19610 - RNA, 20 nt, Artificial Sequence
  Synthetic
gccuguaaucccagcacuuu

SEQ ID NO: 19611 - RNA, 20 nt, Artificial Sequence
  Synthetic
gaacacuuuauaguuuuuuu

SEQ ID NO: 19612 - RNA, 17 nt, Artificial Sequence
  Synthetic
aacaaagaaacaaaaaa

SEQ ID NO: 19613 - RNA, 17 nt, Artificial Sequence
  Synthetic
uaugauuuuaugaaaaa

SEQ ID NO: 19614 - RNA, 17 nt, Artificial Sequence
  Synthetic
ugcaggagaauggaaaa

SEQ ID NO: 19615 - RNA, 17 nt, Artificial Sequence
  Synthetic
ugcauaaagguugaaaa

SEQ ID NO: 19616 - RNA, 17 nt, Artificial Sequence
  Synthetic
uucagaagucuauaaaa

SEQ ID NO: 19617 - RNA, 17 nt, Artificial Sequence
  Synthetic
aaagaaaaaacagcaaa

SEQ ID NO: 19618 - RNA, 17 nt, Artificial Sequence
  Synthetic
aguaaaaaaaaaucaaa

SEQ ID NO: 19619 - RNA, 17 nt, Artificial Sequence
  Synthetic
cuaaaaugacaaucaaa

SEQ ID NO: 19620 - RNA, 17 nt, Artificial Sequence
  Synthetic
aaaagcugaaagucaaa

SEQ ID NO: 19621 - RNA, 17 nt, Artificial Sequence
  Synthetic
auucaaugaaaaagaaa

SEQ ID NO: 19622 - RNA, 17 nt, Artificial Sequence
  Synthetic
uucucacauggcagaaa

SEQ ID NO: 19623 - RNA, 17 nt, Artificial Sequence
  Synthetic
uaaacacuucugagaaa

SEQ ID NO: 19624 - RNA, 17 nt, Artificial Sequence
  Synthetic
uaaacaaacaaaggaaa

SEQ ID NO: 19625 - RNA, 17 nt, Artificial Sequence
  Synthetic
auuaucuuucuaguaaa

SEQ ID NO: 19626 - RNA, 17 nt, Artificial Sequence
  Synthetic
accaaauaaacaaacaa

SEQ ID NO: 19627 - RNA, 17 nt, Artificial Sequence
  Synthetic
auggauaaguugaacaa

SEQ ID NO: 19628 - RNA, 17 nt, Artificial Sequence
  Synthetic
auuaggaaaauguacaa

SEQ ID NO: 19629 - RNA, 17 nt, Artificial Sequence
  Synthetic
uguuuaaauauucccaa

SEQ ID NO: 19630 - RNA, 17 nt, Artificial Sequence
  Synthetic
aaagaauaaggcaucaa

SEQ ID NO: 19631 - RNA, 17 nt, Artificial Sequence
  Synthetic
aaauauauucaaaagaa

SEQ ID NO: 19632 - RNA, 17 nt, Artificial Sequence
  Synthetic
ugagagacaguaaagaa

SEQ ID NO: 19633 - RNA, 17 nt, Artificial Sequence
  Synthetic
aaggaaaugaggaagaa

SEQ ID NO: 19634 - RNA, 17 nt, Artificial Sequence
  Synthetic
aggcugaggcaggagaa

SEQ ID NO: 19635 - RNA, 17 nt, Artificial Sequence
  Synthetic
aaacugaguagaaggaa

SEQ ID NO: 19636 - RNA, 17 nt, Artificial Sequence
  Synthetic
uuucucuuuacugugaa

SEQ ID NO: 19637 - RNA, 17 nt, Artificial Sequence
  Synthetic
aagaaaaguaucaauaa

SEQ ID NO: 19638 - RNA, 17 nt, Artificial Sequence
  Synthetic
cagugacuucauaauaa

SEQ ID NO: 19639 - RNA, 17 nt, Artificial Sequence
  Synthetic
auagagaaaacucauaa

SEQ ID NO: 19640 - RNA, 17 nt, Artificial Sequence
  Synthetic
acaaaaauuaaaacuaa

SEQ ID NO: 19641 - RNA, 17 nt, Artificial Sequence
  Synthetic
ucuagaaaacaauguaa

SEQ ID NO: 19642 - RNA, 17 nt, Artificial Sequence
  Synthetic
agauaaaguugaauuaa

SEQ ID NO: 19643 - RNA, 17 nt, Artificial Sequence
  Synthetic
aagccuguauuguuuaa

SEQ ID NO: 19644 - RNA, 17 nt, Artificial Sequence
  Synthetic
auuuugaccauuuuuaa

SEQ ID NO: 19645 - RNA, 17 nt, Artificial Sequence
  Synthetic
uaccauccuggccaaca

SEQ ID NO: 19646 - RNA, 17 nt, Artificial Sequence
  Synthetic
uuauagcagccugaaca

SEQ ID NO: 19647 - RNA, 17 nt, Artificial Sequence
  Synthetic
uuuaaacagaaguaaca

SEQ ID NO: 19648 - RNA, 17 nt, Artificial Sequence
  Synthetic
agagagaacugcucaca

SEQ ID NO: 19649 - RNA, 17 nt, Artificial Sequence
  Synthetic
ccugcuguguucucaca

SEQ ID NO: 19650 - RNA, 17 nt, Artificial Sequence
  Synthetic
ugaaauccuaauuccca

SEQ ID NO: 19651 - RNA, 17 nt, Artificial Sequence
  Synthetic
uuuauuuuuauauucca

SEQ ID NO: 19652 - RNA, 17 nt, Artificial Sequence
  Synthetic
agacaagggaggaagca

SEQ ID NO: 19653 - RNA, 17 nt, Artificial Sequence
  Synthetic
ucaacauaugaauggca

SEQ ID NO: 19654 - RNA, 17 nt, Artificial Sequence
  Synthetic
uacaggcuugaacugca

SEQ ID NO: 19655 - RNA, 17 nt, Artificial Sequence
  Synthetic
aaggugaugguauugca

SEQ ID NO: 19656 - RNA, 17 nt, Artificial Sequence
  Synthetic
cuauuuaaacagaauca

SEQ ID NO: 19657 - RNA, 17 nt, Artificial Sequence
  Synthetic
ugggaaguccaagauca

SEQ ID NO: 19658 - RNA, 17 nt, Artificial Sequence
  Synthetic
uucacuaaaauaauuca

SEQ ID NO: 19659 - RNA, 17 nt, Artificial Sequence
  Synthetic
uauauuuuaugcauuca

SEQ ID NO: 19660 - RNA, 17 nt, Artificial Sequence
  Synthetic
auaagccacacaguuca

SEQ ID NO: 19661 - RNA, 17 nt, Artificial Sequence
  Synthetic
uugagcccaggaguuca

SEQ ID NO: 19662 - RNA, 17 nt, Artificial Sequence
  Synthetic
aauugguacaaauuuca

SEQ ID NO: 19663 - RNA, 17 nt, Artificial Sequence
  Synthetic
agaggaaggaagaaaga

SEQ ID NO: 19664 - RNA, 17 nt, Artificial Sequence
  Synthetic
agauucuaaaggaaaga

SEQ ID NO: 19665 - RNA, 17 nt, Artificial Sequence
  Synthetic
aaggaaggaaggaaaga

SEQ ID NO: 19666 - RNA, 17 nt, Artificial Sequence
  Synthetic
uguauuuuuaguagaga

SEQ ID NO: 19667 - RNA, 17 nt, Artificial Sequence
  Synthetic
uuuuuuuuuuuuugaga

SEQ ID NO: 19668 - RNA, 17 nt, Artificial Sequence
  Synthetic
cuuuuccucuuaauaga

SEQ ID NO: 19669 - RNA, 17 nt, Artificial Sequence
  Synthetic
auauucaaaagaaagga

SEQ ID NO: 19670 - RNA, 17 nt, Artificial Sequence
  Synthetic
aaggaaggaaagaagga

SEQ ID NO: 19671 - RNA, 17 nt, Artificial Sequence
  Synthetic
cacuguguuagccagga

SEQ ID NO: 19672 - RNA, 17 nt, Artificial Sequence
  Synthetic
caccauguuggccagga

SEQ ID NO: 19673 - RNA, 17 nt, Artificial Sequence
  Synthetic
aaggcagaguuagagga

SEQ ID NO: 19674 - RNA, 17 nt, Artificial Sequence
  Synthetic
aaaauuauacuauagga

SEQ ID NO: 19675 - RNA, 17 nt, Artificial Sequence
  Synthetic
auagaguaagacaggga

SEQ ID NO: 19676 - RNA, 17 nt, Artificial Sequence
  Synthetic
caccguuuuagccggga

SEQ ID NO: 19677 - RNA, 17 nt, Artificial Sequence
  Synthetic
uggacugaguaacugga

SEQ ID NO: 19678 - RNA, 17 nt, Artificial Sequence
  Synthetic
auauaugugugucugga

SEQ ID NO: 19679 - RNA, 17 nt, Artificial Sequence
  Synthetic
aggugauuaguccauga

SEQ ID NO: 19680 - RNA, 17 nt, Artificial Sequence
  Synthetic
uggcauagcugcacuga

SEQ ID NO: 19681 - RNA, 17 nt, Artificial Sequence
  Synthetic
aaauuagccagacguga

SEQ ID NO: 19682 - RNA, 17 nt, Artificial Sequence
  Synthetic
ccuaauucccaagguga

SEQ ID NO: 19683 - RNA, 17 nt, Artificial Sequence
  Synthetic
agacuugcaggagguga

SEQ ID NO: 19684 - RNA, 17 nt, Artificial Sequence
  Synthetic
auggcagaaagggguga

SEQ ID NO: 19685 - RNA, 17 nt, Artificial Sequence
  Synthetic
uucaggacaugcuuuga

SEQ ID NO: 19686 - RNA, 17 nt, Artificial Sequence
  Synthetic
uucaauucuucaaaaua

SEQ ID NO: 19687 - RNA, 17 nt, Artificial Sequence
  Synthetic
aguauaucaaaagaaua

SEQ ID NO: 19688 - RNA, 17 nt, Artificial Sequence
  Synthetic
ccucugugcuuugaaua

SEQ ID NO: 19689 - RNA, 17 nt, Artificial Sequence
  Synthetic
auaaauguugaauaaua

SEQ ID NO: 19690 - RNA, 17 nt, Artificial Sequence
  Synthetic
cauaguauucuaucaua

SEQ ID NO: 19691 - RNA, 17 nt, Artificial Sequence
  Synthetic
cauagagaaaacucaua

SEQ ID NO: 19692 - RNA, 17 nt, Artificial Sequence
  Synthetic
cugcagaccucaauaua

SEQ ID NO: 19693 - RNA, 17 nt, Artificial Sequence
  Synthetic
aaguuucucaucuuaua

SEQ ID NO: 19694 - RNA, 17 nt, Artificial Sequence
  Synthetic
ccgaguagcugggacua

SEQ ID NO: 19695 - RNA, 17 nt, Artificial Sequence
  Synthetic
ugguuugaagaacagua

SEQ ID NO: 19696 - RNA, 17 nt, Artificial Sequence
  Synthetic
uguuuauguuaucugua

SEQ ID NO: 19697 - RNA, 17 nt, Artificial Sequence
  Synthetic
uuuuaggcuauucugua

SEQ ID NO: 19698 - RNA, 17 nt, Artificial Sequence
  Synthetic
acuaguggcacuuugua

SEQ ID NO: 19699 - RNA, 17 nt, Artificial Sequence
  Synthetic
uuaguuuuaugccauua

SEQ ID NO: 19700 - RNA, 17 nt, Artificial Sequence
  Synthetic
caggaggugagggauua

SEQ ID NO: 19701 - RNA, 17 nt, Artificial Sequence
  Synthetic
acuuccuguugcuauua

SEQ ID NO: 19702 - RNA, 17 nt, Artificial Sequence
  Synthetic
uguauauguguguauua

SEQ ID NO: 19703 - RNA, 17 nt, Artificial Sequence
  Synthetic
auguuauucaagguuua

SEQ ID NO: 19704 - RNA, 17 nt, Artificial Sequence
  Synthetic
cauuuugaccauuuuua

SEQ ID NO: 19705 - RNA, 17 nt, Artificial Sequence
  Synthetic
aagauaaugggagaaac

SEQ ID NO: 19706 - RNA, 17 nt, Artificial Sequence
  Synthetic
uguggcuuauaaacaac

SEQ ID NO: 19707 - RNA, 17 nt, Artificial Sequence
  Synthetic
uuuuaaacagaaguaac

SEQ ID NO: 19708 - RNA, 17 nt, Artificial Sequence
  Synthetic
aaacuguuauaauuaac

SEQ ID NO: 19709 - RNA, 17 nt, Artificial Sequence
  Synthetic
ugacccuuaaacaauac

SEQ ID NO: 19710 - RNA, 17 nt, Artificial Sequence
  Synthetic
caaguagcugggacuac

SEQ ID NO: 19711 - RNA, 17 nt, Artificial Sequence
  Synthetic
cgaguagcugggacuac

SEQ ID NO: 19712 - RNA, 17 nt, Artificial Sequence
  Synthetic
caaagugcugggauuac

SEQ ID NO: 19713 - RNA, 17 nt, Artificial Sequence
  Synthetic
caaaguguugggauuac

SEQ ID NO: 19714 - RNA, 17 nt, Artificial Sequence
  Synthetic
ugcaauaugcaauuuac

SEQ ID NO: 19715 - RNA, 17 nt, Artificial Sequence
  Synthetic
aaauauugacuauuuac

SEQ ID NO: 19716 - RNA, 17 nt, Artificial Sequence
  Synthetic
uauauauauuuuuaacc

SEQ ID NO: 19717 - RNA, 17 nt, Artificial Sequence
  Synthetic
agagucuuacugucacc

SEQ ID NO: 19718 - RNA, 17 nt, Artificial Sequence
  Synthetic
uacuaaaaaaaguuacc

SEQ ID NO: 19719 - RNA, 17 nt, Artificial Sequence
  Synthetic
aaaggucaauugagccc

SEQ ID NO: 19720 - RNA, 17 nt, Artificial Sequence
  Synthetic
ugcaagcuccgccuccc

SEQ ID NO: 19721 - RNA, 17 nt, Artificial Sequence
  Synthetic
ugcaaccucugccuccc

SEQ ID NO: 19722 - RNA, 17 nt, Artificial Sequence
  Synthetic
accacugugcuccagcc

SEQ ID NO: 19723 - RNA, 17 nt, Artificial Sequence
  Synthetic
accacugaaguucagcc

SEQ ID NO: 19724 - RNA, 17 nt, Artificial Sequence
  Synthetic
aauacaaaaaauuagcc

SEQ ID NO: 19725 - RNA, 17 nt, Artificial Sequence
  Synthetic
aagaaaugaaacaggcc

SEQ ID NO: 19726 - RNA, 17 nt, Artificial Sequence
  Synthetic
agagaucaauaccaucc

SEQ ID NO: 19727 - RNA, 17 nt, Artificial Sequence
  Synthetic
ugaugguggcuugaucc

SEQ ID NO: 19728 - RNA, 17 nt, Artificial Sequence
  Synthetic
cgcuggucucaaacucc

SEQ ID NO: 19729 - RNA, 17 nt, Artificial Sequence
  Synthetic
cuguaaccuugaacucc

SEQ ID NO: 19730 - RNA, 17 nt, Artificial Sequence
  Synthetic
cugcaagcuccgccucc

SEQ ID NO: 19731 - RNA, 17 nt, Artificial Sequence
  Synthetic
cugcaaccucugccucc

SEQ ID NO: 19732 - RNA, 17 nt, Artificial Sequence
  Synthetic
cugcaaguucugccucc

SEQ ID NO: 19733 - RNA, 17 nt, Artificial Sequence
  Synthetic
ccaugugagaacacagc

SEQ ID NO: 19734 - RNA, 17 nt, Artificial Sequence
  Synthetic
cacagcaggaagacagc

SEQ ID NO: 19735 - RNA, 17 nt, Artificial Sequence
  Synthetic
agugcagcuaugccagc

SEQ ID NO: 19736 - RNA, 17 nt, Artificial Sequence
  Synthetic
uuuuaaaacaaaauagc

SEQ ID NO: 19737 - RNA, 17 nt, Artificial Sequence
  Synthetic
aaacaaaagaaaauagc

SEQ ID NO: 19738 - RNA, 17 nt, Artificial Sequence
  Synthetic
ucacccucccaaguagc

SEQ ID NO: 19739 - RNA, 17 nt, Artificial Sequence
  Synthetic
ucagccucccaaguagc

SEQ ID NO: 19740 - RNA, 17 nt, Artificial Sequence
  Synthetic
agagucuuccaaguagc

SEQ ID NO: 19741 - RNA, 17 nt, Artificial Sequence
  Synthetic
ucagccucccgaguagc

SEQ ID NO: 19742 - RNA, 17 nt, Artificial Sequence
  Synthetic
aaauacaaaaaauuagc

SEQ ID NO: 19743 - RNA, 17 nt, Artificial Sequence
  Synthetic
ugccauguugcccacgc

SEQ ID NO: 19744 - RNA, 17 nt, Artificial Sequence
  Synthetic
uaagaaaugaaacaggc

SEQ ID NO: 19745 - RNA, 17 nt, Artificial Sequence
  Synthetic
ucuuacugucaccaggc

SEQ ID NO: 19746 - RNA, 17 nt, Artificial Sequence
  Synthetic
cgcucugucgcccaggc

SEQ ID NO: 19747 - RNA, 17 nt, Artificial Sequence
  Synthetic
cuuuuggaggcagaggc

SEQ ID NO: 19748 - RNA, 17 nt, Artificial Sequence
  Synthetic
cuuugggaggccgaggc

SEQ ID NO: 19749 - RNA, 17 nt, Artificial Sequence
  Synthetic
cucacaguucuggaggc

SEQ ID NO: 19750 - RNA, 17 nt, Artificial Sequence
  Synthetic
aaggaggucacugaggc

SEQ ID NO: 19751 - RNA, 17 nt, Artificial Sequence
  Synthetic
acucgggaggcugaggc

SEQ ID NO: 19752 - RNA, 17 nt, Artificial Sequence
  Synthetic
acuugggaggcugaggc

SEQ ID NO: 19753 - RNA, 17 nt, Artificial Sequence
  Synthetic
acuugggagggugaggc

SEQ ID NO: 19754 - RNA, 17 nt, Artificial Sequence
  Synthetic
uucaaggaagagggggc

SEQ ID NO: 19755 - RNA, 17 nt, Artificial Sequence
  Synthetic
uucaacauaugaauggc

SEQ ID NO: 19756 - RNA, 17 nt, Artificial Sequence
  Synthetic
uagccagacgugauggc

SEQ ID NO: 19757 - RNA, 17 nt, Artificial Sequence
  Synthetic
uagccgggcguaguggc

SEQ ID NO: 19758 - RNA, 17 nt, Artificial Sequence
  Synthetic
ucagccucccaaagugc

SEQ ID NO: 19759 - RNA, 17 nt, Artificial Sequence
  Synthetic
ucggccucccaaagugc

SEQ ID NO: 19760 - RNA, 17 nt, Artificial Sequence
  Synthetic
caaggugaugguauugc

SEQ ID NO: 19761 - RNA, 17 nt, Artificial Sequence
  Synthetic
uuugaacaaagacuugc

SEQ ID NO: 19762 - RNA, 17 nt, Artificial Sequence
  Synthetic
cguagucccagcuacuc

SEQ ID NO: 19763 - RNA, 17 nt, Artificial Sequence
  Synthetic
cuccacuucucaggcuc

SEQ ID NO: 19764 - RNA, 17 nt, Artificial Sequence
  Synthetic
auagagagaaacaucuc

SEQ ID NO: 19765 - RNA, 17 nt, Artificial Sequence
  Synthetic
ugcagccuccacuucuc

SEQ ID NO: 19766 - RNA, 17 nt, Artificial Sequence
  Synthetic
agagacaaggugguguc

SEQ ID NO: 19767 - RNA, 17 nt, Artificial Sequence
  Synthetic
ucaauaaauuugguguc

SEQ ID NO: 19768 - RNA, 17 nt, Artificial Sequence
  Synthetic
auguauauauguguguc

SEQ ID NO: 19769 - RNA, 17 nt, Artificial Sequence
  Synthetic
ucuuucuaauuucauuc

SEQ ID NO: 19770 - RNA, 17 nt, Artificial Sequence
  Synthetic
aggaagugaucagauuc

SEQ ID NO: 19771 - RNA, 17 nt, Artificial Sequence
  Synthetic
uaagaggaaaagacuuc

SEQ ID NO: 19772 - RNA, 17 nt, Artificial Sequence
  Synthetic
uuuauuucucacaguuc

SEQ ID NO: 19773 - RNA, 17 nt, Artificial Sequence
  Synthetic
uguguguguccuuguuc

SEQ ID NO: 19774 - RNA, 17 nt, Artificial Sequence
  Synthetic
acuggcaauuaaauuuc

SEQ ID NO: 19775 - RNA, 17 nt, Artificial Sequence
  Synthetic
ucuuuugaauauauuuc

SEQ ID NO: 19776 - RNA, 17 nt, Artificial Sequence
  Synthetic
auaaauaauugccuuuc

SEQ ID NO: 19777 - RNA, 17 nt, Artificial Sequence
  Synthetic
auuauaacacugcuuuc

SEQ ID NO: 19778 - RNA, 17 nt, Artificial Sequence
  Synthetic
aaaauuuguuuucuuuc

SEQ ID NO: 19779 - RNA, 17 nt, Artificial Sequence
  Synthetic
aaaaacauuagccaaag

SEQ ID NO: 19780 - RNA, 17 nt, Artificial Sequence
  Synthetic
ucucacauggcagaaag

SEQ ID NO: 19781 - RNA, 17 nt, Artificial Sequence
  Synthetic
uugauaagaagagaaag

SEQ ID NO: 19782 - RNA, 17 nt, Artificial Sequence
  Synthetic
aagauucuaaaggaaag

SEQ ID NO: 19783 - RNA, 17 nt, Artificial Sequence
  Synthetic
ugaauuuuuuuuccaag

SEQ ID NO: 19784 - RNA, 17 nt, Artificial Sequence
  Synthetic
caccugagccugagaag

SEQ ID NO: 19785 - RNA, 17 nt, Artificial Sequence
  Synthetic
acuuugggaggcugaag

SEQ ID NO: 19786 - RNA, 17 nt, Artificial Sequence
  Synthetic
aaaaauucacaaauaag

SEQ ID NO: 19787 - RNA, 17 nt, Artificial Sequence
  Synthetic
aaauuagaaagaauaag

SEQ ID NO: 19788 - RNA, 17 nt, Artificial Sequence
  Synthetic
aaaaauaaaaauauaag

SEQ ID NO: 19789 - RNA, 17 nt, Artificial Sequence
  Synthetic
agaaggaaggaaguaag

SEQ ID NO: 19790 - RNA, 17 nt, Artificial Sequence
  Synthetic
ccauauucaaagcacag

SEQ ID NO: 19791 - RNA, 17 nt, Artificial Sequence
  Synthetic
accaggcuggagcacag

SEQ ID NO: 19792 - RNA, 17 nt, Artificial Sequence
  Synthetic
uuaauggcugugcacag

SEQ ID NO: 19793 - RNA, 17 nt, Artificial Sequence
  Synthetic
uaugagaaaagucacag

SEQ ID NO: 19794 - RNA, 17 nt, Artificial Sequence
  Synthetic
ccuaggcuaggguacag

SEQ ID NO: 19795 - RNA, 17 nt, Artificial Sequence
  Synthetic
uguuuaaaacucuccag

SEQ ID NO: 19796 - RNA, 17 nt, Artificial Sequence
  Synthetic
cuauauuuguuuuccag

SEQ ID NO: 19797 - RNA, 17 nt, Artificial Sequence
  Synthetic
aggaaaggagguagcag

SEQ ID NO: 19798 - RNA, 17 nt, Artificial Sequence
  Synthetic
uugagcccgggaggcag

SEQ ID NO: 19799 - RNA, 17 nt, Artificial Sequence
  Synthetic
agcacuuuuggaggcag

SEQ ID NO: 19800 - RNA, 17 nt, Artificial Sequence
  Synthetic
caacauaugaauggcag

SEQ ID NO: 19801 - RNA, 17 nt, Artificial Sequence
  Synthetic
cccaggcuagagugcag

SEQ ID NO: 19802 - RNA, 17 nt, Artificial Sequence
  Synthetic
cccaggcuggagugcag

SEQ ID NO: 19803 - RNA, 17 nt, Artificial Sequence
  Synthetic
ugucaggcugggugcag

SEQ ID NO: 19804 - RNA, 17 nt, Artificial Sequence
  Synthetic
uauuuaaacagaaucag

SEQ ID NO: 19805 - RNA, 17 nt, Artificial Sequence
  Synthetic
aauguuaauuuauucag

SEQ ID NO: 19806 - RNA, 17 nt, Artificial Sequence
  Synthetic
cccaggcugaacuucag

SEQ ID NO: 19807 - RNA, 17 nt, Artificial Sequence
  Synthetic
uuguuacauaaaaagag

SEQ ID NO: 19808 - RNA, 17 nt, Artificial Sequence
  Synthetic
aacagaaaaagaaagag

SEQ ID NO: 19809 - RNA, 17 nt, Artificial Sequence
  Synthetic
aaauuauacuauaggag

SEQ ID NO: 19810 - RNA, 17 nt, Artificial Sequence
  Synthetic
aauagccuauuguugag

SEQ ID NO: 19811 - RNA, 17 nt, Artificial Sequence
  Synthetic
uaaauguugaauaauag

SEQ ID NO: 19812 - RNA, 17 nt, Artificial Sequence
  Synthetic
uagaugauuauuaauag

SEQ ID NO: 19813 - RNA, 17 nt, Artificial Sequence
  Synthetic
uaaaaagugaucucuag

SEQ ID NO: 19814 - RNA, 17 nt, Artificial Sequence
  Synthetic
aaauuagccgggcguag

SEQ ID NO: 19815 - RNA, 17 nt, Artificial Sequence
  Synthetic
uaugaaggcagaguuag

SEQ ID NO: 19816 - RNA, 17 nt, Artificial Sequence
  Synthetic
agaugauuagcaucacg

SEQ ID NO: 19817 - RNA, 17 nt, Artificial Sequence
  Synthetic
uauuuuuaguagagacg

SEQ ID NO: 19818 - RNA, 17 nt, Artificial Sequence
  Synthetic
aacacuuugggaggccg

SEQ ID NO: 19819 - RNA, 17 nt, Artificial Sequence
  Synthetic
agcacuuugggaggccg

SEQ ID NO: 19820 - RNA, 17 nt, Artificial Sequence
  Synthetic
augaaacaggccgggcg

SEQ ID NO: 19821 - RNA, 17 nt, Artificial Sequence
  Synthetic
aaaaaaaaaucaaaagg

SEQ ID NO: 19822 - RNA, 17 nt, Artificial Sequence
  Synthetic
cugaguagaaggaaagg

SEQ ID NO: 19823 - RNA, 17 nt, Artificial Sequence
  Synthetic
uuugaagaacaguaagg

SEQ ID NO: 19824 - RNA, 17 nt, Artificial Sequence
  Synthetic
aauggcgugaacccagg

SEQ ID NO: 19825 - RNA, 17 nt, Artificial Sequence
  Synthetic
uaguuucaaggaagagg

SEQ ID NO: 19826 - RNA, 17 nt, Artificial Sequence
  Synthetic
uuacauaaaaagagagg

SEQ ID NO: 19827 - RNA, 17 nt, Artificial Sequence
  Synthetic
uguguuuuuuguagagg

SEQ ID NO: 19828 - RNA, 17 nt, Artificial Sequence
  Synthetic
acuuugggaggccgagg

SEQ ID NO: 19829 - RNA, 17 nt, Artificial Sequence
  Synthetic
uacuugggaggcugagg

SEQ ID NO: 19830 - RNA, 17 nt, Artificial Sequence
  Synthetic
aaaaauuauacuauagg

SEQ ID NO: 19831 - RNA, 17 nt, Artificial Sequence
  Synthetic
aaacaggccgggcgcgg

SEQ ID NO: 19832 - RNA, 17 nt, Artificial Sequence
  Synthetic
cuguagggagacaaggg

SEQ ID NO: 19833 - RNA, 17 nt, Artificial Sequence
  Synthetic
aauggcgugaacccggg

SEQ ID NO: 19834 - RNA, 17 nt, Artificial Sequence
  Synthetic
aauugcuugagcccggg

SEQ ID NO: 19835 - RNA, 17 nt, Artificial Sequence
  Synthetic
ugggaggccgaggcggg

SEQ ID NO: 19836 - RNA, 17 nt, Artificial Sequence
  Synthetic
agucccagcuacucggg

SEQ ID NO: 19837 - RNA, 17 nt, Artificial Sequence
  Synthetic
ugggaggcugagguggg

SEQ ID NO: 19838 - RNA, 17 nt, Artificial Sequence
  Synthetic
agucccagcuacuuggg

SEQ ID NO: 19839 - RNA, 17 nt, Artificial Sequence
  Synthetic
aaacccagcacuuuggg

SEQ ID NO: 19840 - RNA, 17 nt, Artificial Sequence
  Synthetic
aaucccagcacuuuggg

SEQ ID NO: 19841 - RNA, 17 nt, Artificial Sequence
  Synthetic
aggguggggccuuuggg

SEQ ID NO: 19842 - RNA, 17 nt, Artificial Sequence
  Synthetic
caggcaagugaugaugg

SEQ ID NO: 19843 - RNA, 17 nt, Artificial Sequence
  Synthetic
uuagccagacgugaugg

SEQ ID NO: 19844 - RNA, 17 nt, Artificial Sequence
  Synthetic
auuucucacaguucugg

SEQ ID NO: 19845 - RNA, 17 nt, Artificial Sequence
  Synthetic
cugagccugagaagugg

SEQ ID NO: 19846 - RNA, 17 nt, Artificial Sequence
  Synthetic
aggcuggagugcagugg

SEQ ID NO: 19847 - RNA, 17 nt, Artificial Sequence
  Synthetic
uuagccgggcguagugg

SEQ ID NO: 19848 - RNA, 17 nt, Artificial Sequence
  Synthetic
aaaauagcugggugugg

SEQ ID NO: 19849 - RNA, 17 nt, Artificial Sequence
  Synthetic
ucaaaaaauauuugugg

SEQ ID NO: 19850 - RNA, 17 nt, Artificial Sequence
  Synthetic
aauccuagcacuuuugg

SEQ ID NO: 19851 - RNA, 17 nt, Artificial Sequence
  Synthetic
aauuuuauauagaaaug

SEQ ID NO: 19852 - RNA, 17 nt, Artificial Sequence
  Synthetic
aacaaacaaaggaaaug

SEQ ID NO: 19853 - RNA, 17 nt, Artificial Sequence
  Synthetic
aagcuagugaaugaaug

SEQ ID NO: 19854 - RNA, 17 nt, Artificial Sequence
  Synthetic
auuauucaacauuuaug

SEQ ID NO: 19855 - RNA, 17 nt, Artificial Sequence
  Synthetic
caguaaggaggucacug

SEQ ID NO: 19856 - RNA, 17 nt, Artificial Sequence
  Synthetic
agcuacucgggaggcug

SEQ ID NO: 19857 - RNA, 17 nt, Artificial Sequence
  Synthetic
agcuacuugggaggcug

SEQ ID NO: 19858 - RNA, 17 nt, Artificial Sequence
  Synthetic
caaaaauuagcugagug

SEQ ID NO: 19859 - RNA, 17 nt, Artificial Sequence
  Synthetic
acauaaaaagagaggug

SEQ ID NO: 19860 - RNA, 17 nt, Artificial Sequence
  Synthetic
uguuuuuuguagaggug

SEQ ID NO: 19861 - RNA, 17 nt, Artificial Sequence
  Synthetic
aagacuugcaggaggug

SEQ ID NO: 19862 - RNA, 17 nt, Artificial Sequence
  Synthetic
agcuacuugggagggug

SEQ ID NO: 19863 - RNA, 17 nt, Artificial Sequence
  Synthetic
cauggcagaaaggggug

SEQ ID NO: 19864 - RNA, 17 nt, Artificial Sequence
  Synthetic
aagaaaauagcugggug

SEQ ID NO: 19865 - RNA, 17 nt, Artificial Sequence
  Synthetic
aaauaccaugaacugug

SEQ ID NO: 19866 - RNA, 17 nt, Artificial Sequence
  Synthetic
uuuauaaaaaauaauug

SEQ ID NO: 19867 - RNA, 17 nt, Artificial Sequence
  Synthetic
uauucaaaaaauauuug

SEQ ID NO: 19868 - RNA, 17 nt, Artificial Sequence
  Synthetic
acauuggaaaauuuuug

SEQ ID NO: 19869 - RNA, 17 nt, Artificial Sequence
  Synthetic
uaguaguuaaguuuuug

SEQ ID NO: 19870 - RNA, 17 nt, Artificial Sequence
  Synthetic
ucaaaaaaaaaaaaaau

SEQ ID NO: 19871 - RNA, 17 nt, Artificial Sequence
  Synthetic
uaaaaugacaaucaaau

SEQ ID NO: 19872 - RNA, 17 nt, Artificial Sequence
  Synthetic
cuauuuggaugucaaau

SEQ ID NO: 19873 - RNA, 17 nt, Artificial Sequence
  Synthetic
aaacaaacaaaggaaau

SEQ ID NO: 19874 - RNA, 17 nt, Artificial Sequence
  Synthetic
uugaaggaagauccaau

SEQ ID NO: 19875 - RNA, 17 nt, Artificial Sequence
  Synthetic
cauaaauguugaauaau

SEQ ID NO: 19876 - RNA, 17 nt, Artificial Sequence
  Synthetic
uuuacuagaaagauaau

SEQ ID NO: 19877 - RNA, 17 nt, Artificial Sequence
  Synthetic
acugucagagaaguaau

SEQ ID NO: 19878 - RNA, 17 nt, Artificial Sequence
  Synthetic
uuuuucaguuaauacau

SEQ ID NO: 19879 - RNA, 17 nt, Artificial Sequence
  Synthetic
uacaauucuuauuacau

SEQ ID NO: 19880 - RNA, 17 nt, Artificial Sequence
  Synthetic
acaggcuugaacugcau

SEQ ID NO: 19881 - RNA, 17 nt, Artificial Sequence
  Synthetic
acccuagccuaggugau

SEQ ID NO: 19882 - RNA, 17 nt, Artificial Sequence
  Synthetic
uuguguuaacaaaauau

SEQ ID NO: 19883 - RNA, 17 nt, Artificial Sequence
  Synthetic
aauauauauaugcauau

SEQ ID NO: 19884 - RNA, 17 nt, Artificial Sequence
  Synthetic
uuaaaaaauuauacuau

SEQ ID NO: 19885 - RNA, 17 nt, Artificial Sequence
  Synthetic
aaaguuucucaucuuau

SEQ ID NO: 19886 - RNA, 17 nt, Artificial Sequence
  Synthetic
uauuauucaacauuuau

SEQ ID NO: 19887 - RNA, 17 nt, Artificial Sequence
  Synthetic
caaagugcuggguuuau

SEQ ID NO: 19888 - RNA, 17 nt, Artificial Sequence
  Synthetic
ucagacuuuuauuuuau

SEQ ID NO: 19889 - RNA, 17 nt, Artificial Sequence
  Synthetic
uuuaacaaaccuuuuau

SEQ ID NO: 19890 - RNA, 17 nt, Artificial Sequence
  Synthetic
uuccaaauuuuuuuuau

SEQ ID NO: 19891 - RNA, 17 nt, Artificial Sequence
  Synthetic
uuauucuuguaauaacu

SEQ ID NO: 19892 - RNA, 17 nt, Artificial Sequence
  Synthetic
ccguagucccagcuacu

SEQ ID NO: 19893 - RNA, 17 nt, Artificial Sequence
  Synthetic
cuguagucccagcuacu

SEQ ID NO: 19894 - RNA, 17 nt, Artificial Sequence
  Synthetic
cugcaauaccaucaccu

SEQ ID NO: 19895 - RNA, 17 nt, Artificial Sequence
  Synthetic
ccacugcacuccagccu

SEQ ID NO: 19896 - RNA, 17 nt, Artificial Sequence
  Synthetic
ccacugaaguucagccu

SEQ ID NO: 19897 - RNA, 17 nt, Artificial Sequence
  Synthetic
ccacuguacccuagccu

SEQ ID NO: 19898 - RNA, 17 nt, Artificial Sequence
  Synthetic
ccacugcacucuagccu

SEQ ID NO: 19899 - RNA, 17 nt, Artificial Sequence
  Synthetic
ucgugauccgcccgccu

SEQ ID NO: 19900 - RNA, 17 nt, Artificial Sequence
  Synthetic
ucaugaucugccugccu

SEQ ID NO: 19901 - RNA, 17 nt, Artificial Sequence
  Synthetic
uguaaccuugaacuccu

SEQ ID NO: 19902 - RNA, 17 nt, Artificial Sequence
  Synthetic
ugcaaguucugccuccu

SEQ ID NO: 19903 - RNA, 17 nt, Artificial Sequence
  Synthetic
agguuuuggauggagcu

SEQ ID NO: 19904 - RNA, 17 nt, Artificial Sequence
  Synthetic
aacaaaagaaaauagcu

SEQ ID NO: 19905 - RNA, 17 nt, Artificial Sequence
  Synthetic
cacccucccaaguagcu

SEQ ID NO: 19906 - RNA, 17 nt, Artificial Sequence
  Synthetic
cagccucccaaguagcu

SEQ ID NO: 19907 - RNA, 17 nt, Artificial Sequence
  Synthetic
cagccucccgaguagcu

SEQ ID NO: 19908 - RNA, 17 nt, Artificial Sequence
  Synthetic
ucacaguucuggaggcu

SEQ ID NO: 19909 - RNA, 17 nt, Artificial Sequence
  Synthetic
aaauuauuucuacugcu

SEQ ID NO: 19910 - RNA, 17 nt, Artificial Sequence
  Synthetic
cugccuccaaaagugcu

SEQ ID NO: 19911 - RNA, 17 nt, Artificial Sequence
  Synthetic
cagccucccaaagugcu

SEQ ID NO: 19912 - RNA, 17 nt, Artificial Sequence
  Synthetic
cggccucccaaagugcu

SEQ ID NO: 19913 - RNA, 17 nt, Artificial Sequence
  Synthetic
aaaaaaguugaguugcu

SEQ ID NO: 19914 - RNA, 17 nt, Artificial Sequence
  Synthetic
ugcuggcaccuugaucu

SEQ ID NO: 19915 - RNA, 17 nt, Artificial Sequence
  Synthetic
ugcuuuucccacuaucu

SEQ ID NO: 19916 - RNA, 17 nt, Artificial Sequence
  Synthetic
aauuugaacaacauucu

SEQ ID NO: 19917 - RNA, 17 nt, Artificial Sequence
  Synthetic
uuuuucauuaugauucu

SEQ ID NO: 19918 - RNA, 17 nt, Artificial Sequence
  Synthetic
cuuuuucuuaauuuucu

SEQ ID NO: 19919 - RNA, 17 nt, Artificial Sequence
  Synthetic
ugaggaagaaaggaagu

SEQ ID NO: 19920 - RNA, 17 nt, Artificial Sequence
  Synthetic
ucugcaauuguaucagu

SEQ ID NO: 19921 - RNA, 17 nt, Artificial Sequence
  Synthetic
caguuuuauuuuucagu

SEQ ID NO: 19922 - RNA, 17 nt, Artificial Sequence
  Synthetic
acauuuuccuaaugagu

SEQ ID NO: 19923 - RNA, 17 nt, Artificial Sequence
  Synthetic
aguggaaguaguauagu

SEQ ID NO: 19924 - RNA, 17 nt, Artificial Sequence
  Synthetic
uacauaaaaagagaggu

SEQ ID NO: 19925 - RNA, 17 nt, Artificial Sequence
  Synthetic
uuagagguuaaggaggu

SEQ ID NO: 19926 - RNA, 17 nt, Artificial Sequence
  Synthetic
acuugggaggcugaggu

SEQ ID NO: 19927 - RNA, 17 nt, Artificial Sequence
  Synthetic
acgggguuucaccaugu

SEQ ID NO: 19928 - RNA, 17 nt, Artificial Sequence
  Synthetic
ucggccucccaaagugu

SEQ ID NO: 19929 - RNA, 17 nt, Artificial Sequence
  Synthetic
agaagagaaaggggugu

SEQ ID NO: 19930 - RNA, 17 nt, Artificial Sequence
  Synthetic
acccaauaaaaaaaauu

SEQ ID NO: 19931 - RNA, 17 nt, Artificial Sequence
  Synthetic
uuuccacucaauaaauu

SEQ ID NO: 19932 - RNA, 17 nt, Artificial Sequence
  Synthetic
ccaucaccuugggaauu

SEQ ID NO: 19933 - RNA, 17 nt, Artificial Sequence
  Synthetic
cacuauugauugacauu

SEQ ID NO: 19934 - RNA, 17 nt, Artificial Sequence
  Synthetic
caaggugccagcagauu

SEQ ID NO: 19935 - RNA, 17 nt, Artificial Sequence
  Synthetic
uauucuuuuuagagauu

SEQ ID NO: 19936 - RNA, 17 nt, Artificial Sequence
  Synthetic
uacuuuucuuccugauu

SEQ ID NO: 19937 - RNA, 17 nt, Artificial Sequence
  Synthetic
uuuucauugaauguauu

SEQ ID NO: 19938 - RNA, 17 nt, Artificial Sequence
  Synthetic
uccuuuguuuguuuauu

SEQ ID NO: 19939 - RNA, 17 nt, Artificial Sequence
  Synthetic
cagacuuuuauuuuauu

SEQ ID NO: 19940 - RNA, 17 nt, Artificial Sequence
  Synthetic
uccaaauuuuuuuuauu

SEQ ID NO: 19941 - RNA, 17 nt, Artificial Sequence
  Synthetic
cuguaaucccaacacuu

SEQ ID NO: 19942 - RNA, 17 nt, Artificial Sequence
  Synthetic
aaguaacagggccacuu

SEQ ID NO: 19943 - RNA, 17 nt, Artificial Sequence
  Synthetic
cuauaaacccagcacuu

SEQ ID NO: 19944 - RNA, 17 nt, Artificial Sequence
  Synthetic
cuguaaucccagcacuu

SEQ ID NO: 19945 - RNA, 17 nt, Artificial Sequence
  Synthetic
aauugaauaugagacuu

SEQ ID NO: 19946 - RNA, 17 nt, Artificial Sequence
  Synthetic
uguagucccagcuacuu

SEQ ID NO: 19947 - RNA, 17 nt, Artificial Sequence
  Synthetic
ugcaauaccaucaccuu

SEQ ID NO: 19948 - RNA, 17 nt, Artificial Sequence
  Synthetic
auguuaaauuuucccuu

SEQ ID NO: 19949 - RNA, 17 nt, Artificial Sequence
  Synthetic
uucccuuaggauaucuu

SEQ ID NO: 19950 - RNA, 17 nt, Artificial Sequence
  Synthetic
aagcaaggagaugaguu

SEQ ID NO: 19951 - RNA, 17 nt, Artificial Sequence
  Synthetic
cggccucccaaaguguu

SEQ ID NO: 19952 - RNA, 17 nt, Artificial Sequence
  Synthetic
uguuaucucugaaauuu

SEQ ID NO: 19953 - RNA, 17 nt, Artificial Sequence
  Synthetic
uuugauuagauaaauuu

SEQ ID NO: 19954 - RNA, 17 nt, Artificial Sequence
  Synthetic
ucaauauuuuggaauuu

SEQ ID NO: 19955 - RNA, 17 nt, Artificial Sequence
  Synthetic
acuauugauugacauuu

SEQ ID NO: 19956 - RNA, 17 nt, Artificial Sequence
  Synthetic
aaggugccagcagauuu

SEQ ID NO: 19957 - RNA, 17 nt, Artificial Sequence
  Synthetic
uaguuuuaucaauauuu

SEQ ID NO: 19958 - RNA, 17 nt, Artificial Sequence
  Synthetic
ucucugcaaacauauuu

SEQ ID NO: 19959 - RNA, 17 nt, Artificial Sequence
  Synthetic
cauuauucaugauauuu

SEQ ID NO: 19960 - RNA, 17 nt, Artificial Sequence
  Synthetic
uuucauugaauguauuu

SEQ ID NO: 19961 - RNA, 17 nt, Artificial Sequence
  Synthetic
uguaaucccaacacuuu

SEQ ID NO: 19962 - RNA, 17 nt, Artificial Sequence
  Synthetic
uauaaacccagcacuuu

SEQ ID NO: 19963 - RNA, 17 nt, Artificial Sequence
  Synthetic
uguaaucccagcacuuu

SEQ ID NO: 19964 - RNA, 17 nt, Artificial Sequence
  Synthetic
uguaauccuagcacuuu

SEQ ID NO: 19965 - RNA, 17 nt, Artificial Sequence
  Synthetic
ugcaggguggggccuuu

SEQ ID NO: 19966 - RNA, 17 nt, Artificial Sequence
  Synthetic
uuuaacugaauaucuuu

SEQ ID NO: 19967 - RNA, 17 nt, Artificial Sequence
  Synthetic
augggagaaacagguuu

SEQ ID NO: 19968 - RNA, 17 nt, Artificial Sequence
  Synthetic
auacauuggaaaauuuu

SEQ ID NO: 19969 - RNA, 17 nt, Artificial Sequence
  Synthetic
caauauuuuggaauuuu

SEQ ID NO: 19970 - RNA, 17 nt, Artificial Sequence
  Synthetic
uacauuggaaaauuuuu

SEQ ID NO: 19971 - RNA, 17 nt, Artificial Sequence
  Synthetic
cuuuggcuaauguuuuu

SEQ ID NO: 19972 - RNA, 17 nt, Artificial Sequence
  Synthetic
cacuuuauaguuuuuuu

SEQ ID NO: 19973 - RNA, 20 nt, Artificial Sequence
  Synthetic
acaaacaaagaaacaaaaaa

SEQ ID NO: 19974 - RNA, 20 nt, Artificial Sequence
  Synthetic
acauaugauuuuaugaaaaa

SEQ ID NO: 19975 - RNA, 20 nt, Artificial Sequence
  Synthetic
cgagaccaucccggcuaaaa

SEQ ID NO: 19976 - RNA, 20 nt, Artificial Sequence
  Synthetic
uagaaagaaaaaacagcaaa

SEQ ID NO: 19977 - RNA, 20 nt, Artificial Sequence
  Synthetic
auuaguaaaaaaaaaucaaa

SEQ ID NO: 19978 - RNA, 20 nt, Artificial Sequence
  Synthetic
aagaaaagcugaaagucaaa

SEQ ID NO: 19979 - RNA, 20 nt, Artificial Sequence
  Synthetic
uacauucaaugaaaaagaaa

SEQ ID NO: 19980 - RNA, 20 nt, Artificial Sequence
  Synthetic
aggguugauaagaagagaaa

SEQ ID NO: 19981 - RNA, 20 nt, Artificial Sequence
  Synthetic
auuuaaacacuucugagaaa

SEQ ID NO: 19982 - RNA, 20 nt, Artificial Sequence
  Synthetic
aaauaaacaaacaaaggaaa

SEQ ID NO: 19983 - RNA, 20 nt, Artificial Sequence
  Synthetic
aaggauguuuauuuaugaaa

SEQ ID NO: 19984 - RNA, 20 nt, Artificial Sequence
  Synthetic
aaaaccaaauaaacaaacaa

SEQ ID NO: 19985 - RNA, 20 nt, Artificial Sequence
  Synthetic
cucauuaggaaaauguacaa

SEQ ID NO: 19986 - RNA, 20 nt, Artificial Sequence
  Synthetic
auggacuaaucaccucccaa

SEQ ID NO: 19987 - RNA, 20 nt, Artificial Sequence
  Synthetic
ucauguugauaaagggucaa

SEQ ID NO: 19988 - RNA, 20 nt, Artificial Sequence
  Synthetic
cugaaauauauucaaaagaa

SEQ ID NO: 19989 - RNA, 20 nt, Artificial Sequence
  Synthetic
agaugagagacaguaaagaa

SEQ ID NO: 19990 - RNA, 20 nt, Artificial Sequence
  Synthetic
aagaaggaaaugaggaagaa

SEQ ID NO: 19991 - RNA, 20 nt, Artificial Sequence
  Synthetic
uguguucucacauggcagaa

SEQ ID NO: 19992 - RNA, 20 nt, Artificial Sequence
  Synthetic
uuugggaggcugaagcggaa

SEQ ID NO: 19993 - RNA, 20 nt, Artificial Sequence
  Synthetic
uuaggauuucaacauaugaa

SEQ ID NO: 19994 - RNA, 20 nt, Artificial Sequence
  Synthetic
acauuucucuuuacugugaa

SEQ ID NO: 19995 - RNA, 20 nt, Artificial Sequence
  Synthetic
aggaagaaaaguaucaauaa

SEQ ID NO: 19996 - RNA, 20 nt, Artificial Sequence
  Synthetic
auacagugacuucauaauaa

SEQ ID NO: 19997 - RNA, 20 nt, Artificial Sequence
  Synthetic
aacauagagaaaacucauaa

SEQ ID NO: 19998 - RNA, 20 nt, Artificial Sequence
  Synthetic
ugaacaaaaauuaaaacuaa

SEQ ID NO: 19999 - RNA, 20 nt, Artificial Sequence
  Synthetic
uuuucuagaaaacaauguaa

SEQ ID NO: 20000 - RNA, 20 nt, Artificial Sequence
  Synthetic
aacagauaaaguugaauuaa

SEQ ID NO: 20001 - RNA, 20 nt, Artificial Sequence
  Synthetic
uguuaccuuucaauguuuaa

SEQ ID NO: 20002 - RNA, 20 nt, Artificial Sequence
  Synthetic
uucaagccuguauuguuuaa

SEQ ID NO: 20003 - RNA, 20 nt, Artificial Sequence
  Synthetic
aucauuuugaccauuuuuaa

SEQ ID NO: 20004 - RNA, 20 nt, Artificial Sequence
  Synthetic
caauaccauccuggccaaca

SEQ ID NO: 20005 - RNA, 20 nt, Artificial Sequence
  Synthetic
ugagaccagcgugggcaaca

SEQ ID NO: 20006 - RNA, 20 nt, Artificial Sequence
  Synthetic
uuguuauagcagccugaaca

SEQ ID NO: 20007 - RNA, 20 nt, Artificial Sequence
  Synthetic
uggagagagaacugcucaca

SEQ ID NO: 20008 - RNA, 20 nt, Artificial Sequence
  Synthetic
cuuccugcuguguucucaca

SEQ ID NO: 20009 - RNA, 20 nt, Artificial Sequence
  Synthetic
aaugaucaauaauagagaca

SEQ ID NO: 20010 - RNA, 20 nt, Artificial Sequence
  Synthetic
auuuuacaauucuuauuaca

SEQ ID NO: 20011 - RNA, 20 nt, Artificial Sequence
  Synthetic
uguugaaauccuaauuccca

SEQ ID NO: 20012 - RNA, 20 nt, Artificial Sequence
  Synthetic
uucuuuauuuuuauauucca

SEQ ID NO: 20013 - RNA, 20 nt, Artificial Sequence
  Synthetic
auuucaacauaugaauggca

SEQ ID NO: 20014 - RNA, 20 nt, Artificial Sequence
  Synthetic
aaagugccacuagugaugca

SEQ ID NO: 20015 - RNA, 20 nt, Artificial Sequence
  Synthetic
caauacaggcuugaacugca

SEQ ID NO: 20016 - RNA, 20 nt, Artificial Sequence
  Synthetic
cccaaggugaugguauugca

SEQ ID NO: 20017 - RNA, 20 nt, Artificial Sequence
  Synthetic
aggguacaguggugcaauca

SEQ ID NO: 20018 - RNA, 20 nt, Artificial Sequence
  Synthetic
ugcuucacuaaaauaauuca

SEQ ID NO: 20019 - RNA, 20 nt, Artificial Sequence
  Synthetic
acauauauuuuaugcauuca

SEQ ID NO: 20020 - RNA, 20 nt, Artificial Sequence
  Synthetic
uuuauaagccacacaguuca

SEQ ID NO: 20021 - RNA, 20 nt, Artificial Sequence
  Synthetic
caauugagcccaggaguuca

SEQ ID NO: 20022 - RNA, 20 nt, Artificial Sequence
  Synthetic
aagagaggaaggaagaaaga

SEQ ID NO: 20023 - RNA, 20 nt, Artificial Sequence
  Synthetic
aggaaggaaggaaggaaaga

SEQ ID NO: 20024 - RNA, 20 nt, Artificial Sequence
  Synthetic
aaagaaggaaggaaguaaga

SEQ ID NO: 20025 - RNA, 20 nt, Artificial Sequence
  Synthetic
aaugaaagcaauaguagaga

SEQ ID NO: 20026 - RNA, 20 nt, Artificial Sequence
  Synthetic
uuuuguauuuuuaguagaga

SEQ ID NO: 20027 - RNA, 20 nt, Artificial Sequence
  Synthetic
uuuuuuuuuuuuuuuugaga

SEQ ID NO: 20028 - RNA, 20 nt, Artificial Sequence
  Synthetic
agucuuuuccucuuaauaga

SEQ ID NO: 20029 - RNA, 20 nt, Artificial Sequence
  Synthetic
aauauauucaaaagaaagga

SEQ ID NO: 20030 - RNA, 20 nt, Artificial Sequence
  Synthetic
aggaaggaaggaaagaagga

SEQ ID NO: 20031 - RNA, 20 nt, Artificial Sequence
  Synthetic
aaaggaaguaggaggaagga

SEQ ID NO: 20032 - RNA, 20 nt, Artificial Sequence
  Synthetic
uuucacuguguuagccagga

SEQ ID NO: 20033 - RNA, 20 nt, Artificial Sequence
  Synthetic
uuucaccauguuggccagga

SEQ ID NO: 20034 - RNA, 20 nt, Artificial Sequence
  Synthetic
acagaaaaagaaagagagga

SEQ ID NO: 20035 - RNA, 20 nt, Artificial Sequence
  Synthetic
augaaggcagaguuagagga

SEQ ID NO: 20036 - RNA, 20 nt, Artificial Sequence
  Synthetic
uaaaaaauuauacuauagga

SEQ ID NO: 20037 - RNA, 20 nt, Artificial Sequence
  Synthetic
auugguacaaauuucaggga

SEQ ID NO: 20038 - RNA, 20 nt, Artificial Sequence
  Synthetic
uuucaccguuuuagccggga

SEQ ID NO: 20039 - RNA, 20 nt, Artificial Sequence
  Synthetic
auaguauucuaucauaugga

SEQ ID NO: 20040 - RNA, 20 nt, Artificial Sequence
  Synthetic
uucuggacugaguaacugga

SEQ ID NO: 20041 - RNA, 20 nt, Artificial Sequence
  Synthetic
uguauauaugugugucugga

SEQ ID NO: 20042 - RNA, 20 nt, Artificial Sequence
  Synthetic
ugggagaaacagguuuugga

SEQ ID NO: 20043 - RNA, 20 nt, Artificial Sequence
  Synthetic
uugacccuuuaucaacauga

SEQ ID NO: 20044 - RNA, 20 nt, Artificial Sequence
  Synthetic
ugcuggcauagcugcacuga

SEQ ID NO: 20045 - RNA, 20 nt, Artificial Sequence
  Synthetic
aaaaaauuagccagacguga

SEQ ID NO: 20046 - RNA, 20 nt, Artificial Sequence
  Synthetic
aauccuaauucccaagguga

SEQ ID NO: 20047 - RNA, 20 nt, Artificial Sequence
  Synthetic
caaagacuugcaggagguga

SEQ ID NO: 20048 - RNA, 20 nt, Artificial Sequence
  Synthetic
cacauggcagaaagggguga

SEQ ID NO: 20049 - RNA, 20 nt, Artificial Sequence
  Synthetic
agauucaggacaugcuuuga

SEQ ID NO: 20050 - RNA, 20 nt, Artificial Sequence
  Synthetic
auauucaauucuucaaaaua

SEQ ID NO: 20051 - RNA, 20 nt, Artificial Sequence
  Synthetic
aaaacuaauuguaguacaua

SEQ ID NO: 20052 - RNA, 20 nt, Artificial Sequence
  Synthetic
augcauaguauucuaucaua

SEQ ID NO: 20053 - RNA, 20 nt, Artificial Sequence
  Synthetic
aaacauagagaaaacucaua

SEQ ID NO: 20054 - RNA, 20 nt, Artificial Sequence
  Synthetic
uagcugcagaccucaauaua

SEQ ID NO: 20055 - RNA, 20 nt, Artificial Sequence
  Synthetic
caaaaauuacagaaccuaua

SEQ ID NO: 20056 - RNA, 20 nt, Artificial Sequence
  Synthetic
aaaaaguuucucaucuuaua

SEQ ID NO: 20057 - RNA, 20 nt, Artificial Sequence
  Synthetic
cucccgaguagcugggacua

SEQ ID NO: 20058 - RNA, 20 nt, Artificial Sequence
  Synthetic
aaggggugagggucucucua

SEQ ID NO: 20059 - RNA, 20 nt, Artificial Sequence
  Synthetic
aaggugugagggucucucua

SEQ ID NO: 20060 - RNA, 20 nt, Artificial Sequence
  Synthetic
acugugaauggugccaggua

SEQ ID NO: 20061 - RNA, 20 nt, Artificial Sequence
  Synthetic
aucacuaguggcacuuugua

SEQ ID NO: 20062 - RNA, 20 nt, Artificial Sequence
  Synthetic
uugauguuauucaagguuua

SEQ ID NO: 20063 - RNA, 20 nt, Artificial Sequence
  Synthetic
uaucauuuugaccauuuuua

SEQ ID NO: 20064 - RNA, 20 nt, Artificial Sequence
  Synthetic
uuggaaaaaaaauucaaaac

SEQ ID NO: 20065 - RNA, 20 nt, Artificial Sequence
  Synthetic
cuguguggcuuauaaacaac

SEQ ID NO: 20066 - RNA, 20 nt, Artificial Sequence
  Synthetic
ccaucaucacuugccugaac

SEQ ID NO: 20067 - RNA, 20 nt, Artificial Sequence
  Synthetic
agcuuucuggacugaguaac

SEQ ID NO: 20068 - RNA, 20 nt, Artificial Sequence
  Synthetic
uuuguauuuuuaguagagac

SEQ ID NO: 20069 - RNA, 20 nt, Artificial Sequence
  Synthetic
acaagugccuagcacuugac

SEQ ID NO: 20070 - RNA, 20 nt, Artificial Sequence
  Synthetic
aauugacccuuaaacaauac

SEQ ID NO: 20071 - RNA, 20 nt, Artificial Sequence
  Synthetic
ucccaaguagcugggacuac

SEQ ID NO: 20072 - RNA, 20 nt, Artificial Sequence
  Synthetic
ucccgaguagcugggacuac

SEQ ID NO: 20073 - RNA, 20 nt, Artificial Sequence
  Synthetic
ucccaaagugcugggauuac

SEQ ID NO: 20074 - RNA, 20 nt, Artificial Sequence
  Synthetic
ucccaaaguguugggauuac

SEQ ID NO: 20075 - RNA, 20 nt, Artificial Sequence
  Synthetic
uacugcaauaugcaauuuac

SEQ ID NO: 20076 - RNA, 20 nt, Artificial Sequence
  Synthetic
caggagaauggcgugaaccc

SEQ ID NO: 20077 - RNA, 20 nt, Artificial Sequence
  Synthetic
agagucucacucugucaccc

SEQ ID NO: 20078 - RNA, 20 nt, Artificial Sequence
  Synthetic
uaggucuuacucugucaccc

SEQ ID NO: 20079 - RNA, 20 nt, Artificial Sequence
  Synthetic
cggaaaggucaauugagccc

SEQ ID NO: 20080 - RNA, 20 nt, Artificial Sequence
  Synthetic
caggagaauugcuugagccc

SEQ ID NO: 20081 - RNA, 20 nt, Artificial Sequence
  Synthetic
cacugcaagcuccgccuccc

SEQ ID NO: 20082 - RNA, 20 nt, Artificial Sequence
  Synthetic
cacugcaaccucugccuccc

SEQ ID NO: 20083 - RNA, 20 nt, Artificial Sequence
  Synthetic
cccgccacugcacuccagcc

SEQ ID NO: 20084 - RNA, 20 nt, Artificial Sequence
  Synthetic
cgcaccacugugcuccagcc

SEQ ID NO: 20085 - RNA, 20 nt, Artificial Sequence
  Synthetic
cacaccacugaaguucagcc

SEQ ID NO: 20086 - RNA, 20 nt, Artificial Sequence
  Synthetic
cgcgccacugcacucuagcc

SEQ ID NO: 20087 - RNA, 20 nt, Artificial Sequence
  Synthetic
aaaaauacaaaaaauuagcc

SEQ ID NO: 20088 - RNA, 20 nt, Artificial Sequence
  Synthetic
caggcgcccgccacuacgcc

SEQ ID NO: 20089 - RNA, 20 nt, Artificial Sequence
  Synthetic
caggcgugagccaccgcgcc

SEQ ID NO: 20090 - RNA, 20 nt, Artificial Sequence
  Synthetic
uauaagaaaugaaacaggcc

SEQ ID NO: 20091 - RNA, 20 nt, Artificial Sequence
  Synthetic
uuaggagaucaagaccaucc

SEQ ID NO: 20092 - RNA, 20 nt, Artificial Sequence
  Synthetic
ucaggagaucgagaccaucc

SEQ ID NO: 20093 - RNA, 20 nt, Artificial Sequence
  Synthetic
ucaagagaucaauaccaucc

SEQ ID NO: 20094 - RNA, 20 nt, Artificial Sequence
  Synthetic
ugaugaugguggcuugaucc

SEQ ID NO: 20095 - RNA, 20 nt, Artificial Sequence
  Synthetic
aggaagacagcuggcuaucc

SEQ ID NO: 20096 - RNA, 20 nt, Artificial Sequence
  Synthetic
ccacgcuggucucaaacucc

SEQ ID NO: 20097 - RNA, 20 nt, Artificial Sequence
  Synthetic
ucacuguaaccuugaacucc

SEQ ID NO: 20098 - RNA, 20 nt, Artificial Sequence
  Synthetic
uuauucuuuugauauacucc

SEQ ID NO: 20099 - RNA, 20 nt, Artificial Sequence
  Synthetic
ucacugcaagcuccgccucc

SEQ ID NO: 20100 - RNA, 20 nt, Artificial Sequence
  Synthetic
ucacugcaaccucugccucc

SEQ ID NO: 20101 - RNA, 20 nt, Artificial Sequence
  Synthetic
ucacugcaaguucugccucc

SEQ ID NO: 20102 - RNA, 20 nt, Artificial Sequence
  Synthetic
caggugaauugcuugagucc

SEQ ID NO: 20103 - RNA, 20 nt, Artificial Sequence
  Synthetic
cugccaugugagaacacagc

SEQ ID NO: 20104 - RNA, 20 nt, Artificial Sequence
  Synthetic
aucagugcagcuaugccagc

SEQ ID NO: 20105 - RNA, 20 nt, Artificial Sequence
  Synthetic
agcuuuuaaaacaaaauagc

SEQ ID NO: 20106 - RNA, 20 nt, Artificial Sequence
  Synthetic
cacaaacaaaagaaaauagc

SEQ ID NO: 20107 - RNA, 20 nt, Artificial Sequence
  Synthetic
accucagccucccaaguagc

SEQ ID NO: 20108 - RNA, 20 nt, Artificial Sequence
  Synthetic
uaaaaauacaaaaaauuagc

SEQ ID NO: 20109 - RNA, 20 nt, Artificial Sequence
  Synthetic
cgggguuucaccguuuuagc

SEQ ID NO: 20110 - RNA, 20 nt, Artificial Sequence
  Synthetic
auauaagaaaugaaacaggc

SEQ ID NO: 20111 - RNA, 20 nt, Artificial Sequence
  Synthetic
ucucgcucugucgcccaggc

SEQ ID NO: 20112 - RNA, 20 nt, Artificial Sequence
  Synthetic
caauaaauuuggugucaggc

SEQ ID NO: 20113 - RNA, 20 nt, Artificial Sequence
  Synthetic
acacuuugggaggccgaggc

SEQ ID NO: 20114 - RNA, 20 nt, Artificial Sequence
  Synthetic
uuucucacaguucuggaggc

SEQ ID NO: 20115 - RNA, 20 nt, Artificial Sequence
  Synthetic
aauuagccagacgugauggc

SEQ ID NO: 20116 - RNA, 20 nt, Artificial Sequence
  Synthetic
ccaggcuggagugcaguggc

SEQ ID NO: 20117 - RNA, 20 nt, Artificial Sequence
  Synthetic
aauuagccgggcguaguggc

SEQ ID NO: 20118 - RNA, 20 nt, Artificial Sequence
  Synthetic
cuuagcagacccaaaucugc

SEQ ID NO: 20119 - RNA, 20 nt, Artificial Sequence
  Synthetic
uucauuuaucucgaaauugc

SEQ ID NO: 20120 - RNA, 20 nt, Artificial Sequence
  Synthetic
ucccaaggugaugguauugc

SEQ ID NO: 20121 - RNA, 20 nt, Artificial Sequence
  Synthetic
acauuugaacaaagacuugc

SEQ ID NO: 20122 - RNA, 20 nt, Artificial Sequence
  Synthetic
agccuccacuucucaggcuc

SEQ ID NO: 20123 - RNA, 20 nt, Artificial Sequence
  Synthetic
uauauagagagaaacaucuc

SEQ ID NO: 20124 - RNA, 20 nt, Artificial Sequence
  Synthetic
cacugcagccuccacuucuc

SEQ ID NO: 20125 - RNA, 20 nt, Artificial Sequence
  Synthetic
cgggcacccgccaucacguc

SEQ ID NO: 20126 - RNA, 20 nt, Artificial Sequence
  Synthetic
uaggcaugagccacuguguc

SEQ ID NO: 20127 - RNA, 20 nt, Artificial Sequence
  Synthetic
uguauguauauauguguguc

SEQ ID NO: 20128 - RNA, 20 nt, Artificial Sequence
  Synthetic
uauucuuucuaauuucauuc

SEQ ID NO: 20129 - RNA, 20 nt, Artificial Sequence
  Synthetic
aguaggaagugaucagauuc

SEQ ID NO: 20130 - RNA, 20 nt, Artificial Sequence
  Synthetic
cuuucuuuugaauauauuuc

SEQ ID NO: 20131 - RNA, 20 nt, Artificial Sequence
  Synthetic
aaagaugauuccaagcuuuc

SEQ ID NO: 20132 - RNA, 20 nt, Artificial Sequence
  Synthetic
uucauuauaacacugcuuuc

SEQ ID NO: 20133 - RNA, 20 nt, Artificial Sequence
  Synthetic
aagaaaauuuguuuucuuuc

SEQ ID NO: 20134 - RNA, 20 nt, Artificial Sequence
  Synthetic
uguucucacauggcagaaag

SEQ ID NO: 20135 - RNA, 20 nt, Artificial Sequence
  Synthetic
uuuugaauuuuuuuuccaag

SEQ ID NO: 20136 - RNA, 20 nt, Artificial Sequence
  Synthetic
accguaauagcaacaggaag

SEQ ID NO: 20137 - RNA, 20 nt, Artificial Sequence
  Synthetic
agcacuuugggaggcugaag

SEQ ID NO: 20138 - RNA, 20 nt, Artificial Sequence
  Synthetic
aaaaaaaauucacaaauaag

SEQ ID NO: 20139 - RNA, 20 nt, Artificial Sequence
  Synthetic
augaaauuagaaagaauaag

SEQ ID NO: 20140 - RNA, 20 nt, Artificial Sequence
  Synthetic
aucaaaaauaaaaauauaag

SEQ ID NO: 20141 - RNA, 20 nt, Artificial Sequence
  Synthetic
aucaguaggcuuccuauaag

SEQ ID NO: 20142 - RNA, 20 nt, Artificial Sequence
  Synthetic
auauuaauggcugugcacag

SEQ ID NO: 20143 - RNA, 20 nt, Artificial Sequence
  Synthetic
ucaccuaggcuaggguacag

SEQ ID NO: 20144 - RNA, 20 nt, Artificial Sequence
  Synthetic
uucuguuuaaaacucuccag

SEQ ID NO: 20145 - RNA, 20 nt, Artificial Sequence
  Synthetic
agaaggaaaggagguagcag

SEQ ID NO: 20146 - RNA, 20 nt, Artificial Sequence
  Synthetic
ugcuugagcccgggaggcag

SEQ ID NO: 20147 - RNA, 20 nt, Artificial Sequence
  Synthetic
ccuagcacuuuuggaggcag

SEQ ID NO: 20148 - RNA, 20 nt, Artificial Sequence
  Synthetic
uuucaacauaugaauggcag

SEQ ID NO: 20149 - RNA, 20 nt, Artificial Sequence
  Synthetic
ucacccaggcuagagugcag

SEQ ID NO: 20150 - RNA, 20 nt, Artificial Sequence
  Synthetic
ucgcccaggcuggagugcag

SEQ ID NO: 20151 - RNA, 20 nt, Artificial Sequence
  Synthetic
uggugucaggcugggugcag

SEQ ID NO: 20152 - RNA, 20 nt, Artificial Sequence
  Synthetic
aggaauguuaauuuauucag

SEQ ID NO: 20153 - RNA, 20 nt, Artificial Sequence
  Synthetic
ucacccaggcugaacuucag

SEQ ID NO: 20154 - RNA, 20 nt, Artificial Sequence
  Synthetic
acaaacagaaaaagaaagag

SEQ ID NO: 20155 - RNA, 20 nt, Artificial Sequence
  Synthetic
aaaaaauuauacuauaggag

SEQ ID NO: 20156 - RNA, 20 nt, Artificial Sequence
  Synthetic
acuaauagccuauuguugag

SEQ ID NO: 20157 - RNA, 20 nt, Artificial Sequence
  Synthetic
caguaaaaagugaucucuag

SEQ ID NO: 20158 - RNA, 20 nt, Artificial Sequence
  Synthetic
aaaaaauuagccgggcguag

SEQ ID NO: 20159 - RNA, 20 nt, Artificial Sequence
  Synthetic
aagaagagaaagggguguag

SEQ ID NO: 20160 - RNA, 20 nt, Artificial Sequence
  Synthetic
uuuguuuguguuuuuuguag

SEQ ID NO: 20161 - RNA, 20 nt, Artificial Sequence
  Synthetic
aaaugugagaaaaaguuuag

SEQ ID NO: 20162 - RNA, 20 nt, Artificial Sequence
  Synthetic
cggagaugauuagcaucacg

SEQ ID NO: 20163 - RNA, 20 nt, Artificial Sequence
  Synthetic
uuguauuuuuaguagagacg

SEQ ID NO: 20164 - RNA, 20 nt, Artificial Sequence
  Synthetic
cccaacacuuugggaggccg

SEQ ID NO: 20165 - RNA, 20 nt, Artificial Sequence
  Synthetic
cccagcacuuugggaggccg

SEQ ID NO: 20166 - RNA, 20 nt, Artificial Sequence
  Synthetic
ccaggaguuugagaccagcg

SEQ ID NO: 20167 - RNA, 20 nt, Artificial Sequence
  Synthetic
aguaaaaaaaaaucaaaagg

SEQ ID NO: 20168 - RNA, 20 nt, Artificial Sequence
  Synthetic
aaacugaguagaaggaaagg

SEQ ID NO: 20169 - RNA, 20 nt, Artificial Sequence
  Synthetic
ugguuugaagaacaguaagg

SEQ ID NO: 20170 - RNA, 20 nt, Artificial Sequence
  Synthetic
uuugaacaaagacuugcagg

SEQ ID NO: 20171 - RNA, 20 nt, Artificial Sequence
  Synthetic
agcacuuugggaggccgagg

SEQ ID NO: 20172 - RNA, 20 nt, Artificial Sequence
  Synthetic
aauggcgugaacccgggagg

SEQ ID NO: 20173 - RNA, 20 nt, Artificial Sequence
  Synthetic
agcuacuugggaggcugagg

SEQ ID NO: 20174 - RNA, 20 nt, Artificial Sequence
  Synthetic
uuaaaaaauuauacuauagg

SEQ ID NO: 20175 - RNA, 20 nt, Artificial Sequence
  Synthetic
ugaggaagaaaggaaguagg

SEQ ID NO: 20176 - RNA, 20 nt, Artificial Sequence
  Synthetic
augaaacaggccgggcgcgg

SEQ ID NO: 20177 - RNA, 20 nt, Artificial Sequence
  Synthetic
aaggugaugguauugcaggg

SEQ ID NO: 20178 - RNA, 20 nt, Artificial Sequence
  Synthetic
cuuugggaggccgaggcggg

SEQ ID NO: 20179 - RNA, 20 nt, Artificial Sequence
  Synthetic
cguagucccagcuacucggg

SEQ ID NO: 20180 - RNA, 20 nt, Artificial Sequence
  Synthetic
acuugggaggcugagguggg

SEQ ID NO: 20181 - RNA, 20 nt, Artificial Sequence
  Synthetic
uguagucccagcuacuuggg

SEQ ID NO: 20182 - RNA, 20 nt, Artificial Sequence
  Synthetic
uguaaucccaacacuuuggg

SEQ ID NO: 20183 - RNA, 20 nt, Artificial Sequence
  Synthetic
uauaaacccagcacuuuggg

SEQ ID NO: 20184 - RNA, 20 nt, Artificial Sequence
  Synthetic
uguaaucccagcacuuuggg

SEQ ID NO: 20185 - RNA, 20 nt, Artificial Sequence
  Synthetic
ugcaggguggggccuuuggg

SEQ ID NO: 20186 - RNA, 20 nt, Artificial Sequence
  Synthetic
aaauuagccagacgugaugg

SEQ ID NO: 20187 - RNA, 20 nt, Artificial Sequence
  Synthetic
uuuauuucucacaguucugg

SEQ ID NO: 20188 - RNA, 20 nt, Artificial Sequence
  Synthetic
caccugagccugagaagugg

SEQ ID NO: 20189 - RNA, 20 nt, Artificial Sequence
  Synthetic
cccaggcuggagugcagugg

SEQ ID NO: 20190 - RNA, 20 nt, Artificial Sequence
  Synthetic
aaauuagccgggcguagugg

SEQ ID NO: 20191 - RNA, 20 nt, Artificial Sequence
  Synthetic
aagaaaauagcugggugugg

SEQ ID NO: 20192 - RNA, 20 nt, Artificial Sequence
  Synthetic
uauucaaaaaauauuugugg

SEQ ID NO: 20193 - RNA, 20 nt, Artificial Sequence
  Synthetic
uguaauccuagcacuuuugg

SEQ ID NO: 20194 - RNA, 20 nt, Artificial Sequence
  Synthetic
aggaauuuuauauagaaaug

SEQ ID NO: 20195 - RNA, 20 nt, Artificial Sequence
  Synthetic
auaaacaaacaaaggaaaug

SEQ ID NO: 20196 - RNA, 20 nt, Artificial Sequence
  Synthetic
aaggaagaaagaaggaaaug

SEQ ID NO: 20197 - RNA, 20 nt, Artificial Sequence
  Synthetic
ugggaggugauuaguccaug

SEQ ID NO: 20198 - RNA, 20 nt, Artificial Sequence
  Synthetic
cccagcuacucgggaggcug

SEQ ID NO: 20199 - RNA, 20 nt, Artificial Sequence
  Synthetic
cccagcuacuugggaggcug

SEQ ID NO: 20200 - RNA, 20 nt, Artificial Sequence
  Synthetic
auacaaaaauuagcugagug

SEQ ID NO: 20201 - RNA, 20 nt, Artificial Sequence
  Synthetic
uuguguuuuuuguagaggug

SEQ ID NO: 20202 - RNA, 20 nt, Artificial Sequence
  Synthetic
acaaagacuugcaggaggug

SEQ ID NO: 20203 - RNA, 20 nt, Artificial Sequence
  Synthetic
cccagcuacuugggagggug

SEQ ID NO: 20204 - RNA, 20 nt, Artificial Sequence
  Synthetic
ucacauggcagaaaggggug

SEQ ID NO: 20205 - RNA, 20 nt, Artificial Sequence
  Synthetic
caaaagaaaauagcugggug

SEQ ID NO: 20206 - RNA, 20 nt, Artificial Sequence
  Synthetic
acaaaauaccaugaacugug

SEQ ID NO: 20207 - RNA, 20 nt, Artificial Sequence
  Synthetic
auuuuuauaaaaaauaauug

SEQ ID NO: 20208 - RNA, 20 nt, Artificial Sequence
  Synthetic
aucuauucaaaaaauauuug

SEQ ID NO: 20209 - RNA, 20 nt, Artificial Sequence
  Synthetic
aauacauuggaaaauuuuug

SEQ ID NO: 20210 - RNA, 20 nt, Artificial Sequence
  Synthetic
uauuaguaguuaaguuuuug

SEQ ID NO: 20211 - RNA, 20 nt, Artificial Sequence
  Synthetic
auaguagcaaaugauaaaau

SEQ ID NO: 20212 - RNA, 20 nt, Artificial Sequence
  Synthetic
ucucuauuuggaugucaaau

SEQ ID NO: 20213 - RNA, 20 nt, Artificial Sequence
  Synthetic
aauaaacaaacaaaggaaau

SEQ ID NO: 20214 - RNA, 20 nt, Artificial Sequence
  Synthetic
uaagguuuccacucaacaau

SEQ ID NO: 20215 - RNA, 20 nt, Artificial Sequence
  Synthetic
uuuaccauuaucuacacaau

SEQ ID NO: 20216 - RNA, 20 nt, Artificial Sequence
  Synthetic
ccccauaaauguugaauaau

SEQ ID NO: 20217 - RNA, 20 nt, Artificial Sequence
  Synthetic
uuuuuuuucaguuaauacau

SEQ ID NO: 20218 - RNA, 20 nt, Artificial Sequence
  Synthetic
uuuuacaauucuuauuacau

SEQ ID NO: 20219 - RNA, 20 nt, Artificial Sequence
  Synthetic
aauacaggcuugaacugcau

SEQ ID NO: 20220 - RNA, 20 nt, Artificial Sequence
  Synthetic
uguacccuagccuaggugau

SEQ ID NO: 20221 - RNA, 20 nt, Artificial Sequence
  Synthetic
aaaaauauauauaugcauau

SEQ ID NO: 20222 - RNA, 20 nt, Artificial Sequence
  Synthetic
cuauuaaaaaauuauacuau

SEQ ID NO: 20223 - RNA, 20 nt, Artificial Sequence
  Synthetic
uucucccuguuauuccuuau

SEQ ID NO: 20224 - RNA, 20 nt, Artificial Sequence
  Synthetic
uaaaaaguuucucaucuuau

SEQ ID NO: 20225 - RNA, 20 nt, Artificial Sequence
  Synthetic
ucccaaagugcuggguuuau

SEQ ID NO: 20226 - RNA, 20 nt, Artificial Sequence
  Synthetic
uucucagacuuuuauuuuau

SEQ ID NO: 20227 - RNA, 20 nt, Artificial Sequence
  Synthetic
aguuuccaaauuuuuuuuau

SEQ ID NO: 20228 - RNA, 20 nt, Artificial Sequence
  Synthetic
ugcccguagucccagcuacu

SEQ ID NO: 20229 - RNA, 20 nt, Artificial Sequence
  Synthetic
cgccuguagucccagcuacu

SEQ ID NO: 20230 - RNA, 20 nt, Artificial Sequence
  Synthetic
acccugcaauaccaucaccu

SEQ ID NO: 20231 - RNA, 20 nt, Artificial Sequence
  Synthetic
ccgccacugcacuccagccu

SEQ ID NO: 20232 - RNA, 20 nt, Artificial Sequence
  Synthetic
acaccacugaaguucagccu

SEQ ID NO: 20233 - RNA, 20 nt, Artificial Sequence
  Synthetic
accucgugauccgcccgccu

SEQ ID NO: 20234 - RNA, 20 nt, Artificial Sequence
  Synthetic
accucaugaucugccugccu

SEQ ID NO: 20235 - RNA, 20 nt, Artificial Sequence
  Synthetic
cacuguaaccuugaacuccu

SEQ ID NO: 20236 - RNA, 20 nt, Artificial Sequence
  Synthetic
cacugcaaguucugccuccu

SEQ ID NO: 20237 - RNA, 20 nt, Artificial Sequence
  Synthetic
acaaacaaaagaaaauagcu

SEQ ID NO: 20238 - RNA, 20 nt, Artificial Sequence
  Synthetic
ccucacccucccaaguagcu

SEQ ID NO: 20239 - RNA, 20 nt, Artificial Sequence
  Synthetic
ccucagccucccaaguagcu

SEQ ID NO: 20240 - RNA, 20 nt, Artificial Sequence
  Synthetic
ccucagccucccgaguagcu

SEQ ID NO: 20241 - RNA, 20 nt, Artificial Sequence
  Synthetic
uucucacaguucuggaggcu

SEQ ID NO: 20242 - RNA, 20 nt, Artificial Sequence
  Synthetic
ccucugccuccaaaagugcu

SEQ ID NO: 20243 - RNA, 20 nt, Artificial Sequence
  Synthetic
cuucagccucccaaagugcu

SEQ ID NO: 20244 - RNA, 20 nt, Artificial Sequence
  Synthetic
ccucggccucccaaagugcu

SEQ ID NO: 20245 - RNA, 20 nt, Artificial Sequence
  Synthetic
aagaaaaaaguugaguugcu

SEQ ID NO: 20246 - RNA, 20 nt, Artificial Sequence
  Synthetic
agagugcaguggcgcgaucu

SEQ ID NO: 20247 - RNA, 20 nt, Artificial Sequence
  Synthetic
aucugcuggcaccuugaucu

SEQ ID NO: 20248 - RNA, 20 nt, Artificial Sequence
  Synthetic
aaagcugugcauuuuccucu

SEQ ID NO: 20249 - RNA, 20 nt, Artificial Sequence
  Synthetic
auauagagagaaacaucucu

SEQ ID NO: 20250 - RNA, 20 nt, Artificial Sequence
  Synthetic
auauuuuucauuaugauucu

SEQ ID NO: 20251 - RNA, 20 nt, Artificial Sequence
  Synthetic
uuaauuuucucgguauuucu

SEQ ID NO: 20252 - RNA, 20 nt, Artificial Sequence
  Synthetic
uuacuuuuucuuaauuuucu

SEQ ID NO: 20253 - RNA, 20 nt, Artificial Sequence
  Synthetic
aaaugaggaagaaaggaagu

SEQ ID NO: 20254 - RNA, 20 nt, Artificial Sequence
  Synthetic
uggauuuuugacuauacagu

SEQ ID NO: 20255 - RNA, 20 nt, Artificial Sequence
  Synthetic
acaucugcaauuguaucagu

SEQ ID NO: 20256 - RNA, 20 nt, Artificial Sequence
  Synthetic
auccaaauagagauguuagu

SEQ ID NO: 20257 - RNA, 20 nt, Artificial Sequence
  Synthetic
caggaguuugagaccagcgu

SEQ ID NO: 20258 - RNA, 20 nt, Artificial Sequence
  Synthetic
uuuguguuuuuuguagaggu

SEQ ID NO: 20259 - RNA, 20 nt, Artificial Sequence
  Synthetic
aggugaugguauugcagggu

SEQ ID NO: 20260 - RNA, 20 nt, Artificial Sequence
  Synthetic
ugaauggugccagguagggu

SEQ ID NO: 20261 - RNA, 20 nt, Artificial Sequence
  Synthetic
uuuuugacuauacagugggu

SEQ ID NO: 20262 - RNA, 20 nt, Artificial Sequence
  Synthetic
auaagaagagaaaggggugu

SEQ ID NO: 20263 - RNA, 20 nt, Artificial Sequence
  Synthetic
aaauuuccacucaauaaauu

SEQ ID NO: 20264 - RNA, 20 nt, Artificial Sequence
  Synthetic
auaccaucaccuugggaauu

SEQ ID NO: 20265 - RNA, 20 nt, Artificial Sequence
  Synthetic
augguacuacuguaauaauu

SEQ ID NO: 20266 - RNA, 20 nt, Artificial Sequence
  Synthetic
aaucacuauugauugacauu

SEQ ID NO: 20267 - RNA, 20 nt, Artificial Sequence
  Synthetic
uuuuauucuuuuuagagauu

SEQ ID NO: 20268 - RNA, 20 nt, Artificial Sequence
  Synthetic
cuugcaggaggugagggauu

SEQ ID NO: 20269 - RNA, 20 nt, Artificial Sequence
  Synthetic
ugauacuuuucuuccugauu

SEQ ID NO: 20270 - RNA, 20 nt, Artificial Sequence
  Synthetic
auagaaguagaagaacuauu

SEQ ID NO: 20271 - RNA, 20 nt, Artificial Sequence
  Synthetic
ucuuuuucauugaauguauu

SEQ ID NO: 20272 - RNA, 20 nt, Artificial Sequence
  Synthetic
ucuguuugucuuagauuauu

SEQ ID NO: 20273 - RNA, 20 nt, Artificial Sequence
  Synthetic
auuuccuuuguuuguuuauu

SEQ ID NO: 20274 - RNA, 20 nt, Artificial Sequence
  Synthetic
ucucagacuuuuauuuuauu

SEQ ID NO: 20275 - RNA, 20 nt, Artificial Sequence
  Synthetic
ugccuguaaucccaacacuu

SEQ ID NO: 20276 - RNA, 20 nt, Artificial Sequence
  Synthetic
ugccuauaaacccagcacuu

SEQ ID NO: 20277 - RNA, 20 nt, Artificial Sequence
  Synthetic
cgccuguaaucccagcacuu

SEQ ID NO: 20278 - RNA, 20 nt, Artificial Sequence
  Synthetic
aagaauugaauaugagacuu

SEQ ID NO: 20279 - RNA, 20 nt, Artificial Sequence
  Synthetic
cccugcaauaccaucaccuu

SEQ ID NO: 20280 - RNA, 20 nt, Artificial Sequence
  Synthetic
aaaauguuaaauuuucccuu

SEQ ID NO: 20281 - RNA, 20 nt, Artificial Sequence
  Synthetic
auuuucccuuaggauaucuu

SEQ ID NO: 20282 - RNA, 20 nt, Artificial Sequence
  Synthetic
cuuuuaguuagcauaaaguu

SEQ ID NO: 20283 - RNA, 20 nt, Artificial Sequence
  Synthetic
aggaagcaaggagaugaguu

SEQ ID NO: 20284 - RNA, 20 nt, Artificial Sequence
  Synthetic
ccucggccucccaaaguguu

SEQ ID NO: 20285 - RNA, 20 nt, Artificial Sequence
  Synthetic
aguuguuaucucugaaauuu

SEQ ID NO: 20286 - RNA, 20 nt, Artificial Sequence
  Synthetic
uuaucaauauuuuggaauuu

SEQ ID NO: 20287 - RNA, 20 nt, Artificial Sequence
  Synthetic
aucacuauugauugacauuu

SEQ ID NO: 20288 - RNA, 20 nt, Artificial Sequence
  Synthetic
aucaaggugccagcagauuu

SEQ ID NO: 20289 - RNA, 20 nt, Artificial Sequence
  Synthetic
aaauaguuuuaucaauauuu

SEQ ID NO: 20290 - RNA, 20 nt, Artificial Sequence
  Synthetic
caucauuauucaugauauuu

SEQ ID NO: 20291 - RNA, 20 nt, Artificial Sequence
  Synthetic
cuuuuucauugaauguauuu

SEQ ID NO: 20292 - RNA, 20 nt, Artificial Sequence
  Synthetic
acuuguaauccuagcacuuu

SEQ ID NO: 20293 - RNA, 20 nt, Artificial Sequence
  Synthetic
uauugcaggguggggccuuu

SEQ ID NO: 20294 - RNA, 20 nt, Artificial Sequence
  Synthetic
aaauuuaacugaauaucuuu

SEQ ID NO: 20295 - RNA, 20 nt, Artificial Sequence
  Synthetic
uuaauacauuggaaaauuuu

SEQ ID NO: 20296 - RNA, 20 nt, Artificial Sequence
  Synthetic
uaucaauauuuuggaauuuu

SEQ ID NO: 20297 - RNA, 20 nt, Artificial Sequence
  Synthetic
uaauacauuggaaaauuuuu

SEQ ID NO: 20298 - RNA, 20 nt, Artificial Sequence
  Synthetic
gauaauacuacugacuaaaa

SEQ ID NO: 20299 - RNA, 21 nt, Artificial Sequence
  Synthetic
guaacuccagugcuauuuaaa

SEQ ID NO: 20300 - RNA, 22 nt, Artificial Sequence
  Synthetic
gguaacuccagugcuauuuaaa

SEQ ID NO: 20301 - RNA, 19 nt, Artificial Sequence
  Synthetic
gacuccaggaguauaucaa

SEQ ID NO: 20302 - RNA, 20 nt, Artificial Sequence
  Synthetic
ggacuccaggaguauaucaa

SEQ ID NO: 20303 - RNA, 22 nt, Artificial Sequence
  Synthetic
guggacuccaggaguauaucaa

SEQ ID NO: 20304 - RNA, 19 nt, Artificial Sequence
  Synthetic
gaugagagacaguaaagaa

SEQ ID NO: 20305 - RNA, 21 nt, Artificial Sequence
  Synthetic
gcuauuuuugcacaucuauca

SEQ ID NO: 20306 - RNA, 18 nt, Artificial Sequence
  Synthetic
gcuaccuugguuggauga

SEQ ID NO: 20307 - RNA, 19 nt, Artificial Sequence
  Synthetic
ggcuaccuugguuggauga

SEQ ID NO: 20308 - RNA, 23 nt, Artificial Sequence
  Synthetic
gauuggcuaccuugguuggauga

SEQ ID NO: 20309 - RNA, 24 nt, Artificial Sequence
  Synthetic
ggauuggcuaccuugguuggauga

SEQ ID NO: 20310 - RNA, 18 nt, Artificial Sequence
  Synthetic
gaauauccauccauauga

SEQ ID NO: 20311 - RNA, 18 nt, Artificial Sequence
  Synthetic
guuacaacagucuuuaua

SEQ ID NO: 20312 - RNA, 23 nt, Artificial Sequence
  Synthetic
guucaacuuauccauuaauccua

SEQ ID NO: 20313 - RNA, 21 nt, Artificial Sequence
  Synthetic
gauacaaauuaccaaauugua

SEQ ID NO: 20314 - RNA, 24 nt, Artificial Sequence
  Synthetic
gcacccagccugacaccaaauuua

SEQ ID NO: 20315 - RNA, 20 nt, Artificial Sequence
  Synthetic
guacaaauauugacuauuua

SEQ ID NO: 20316 - RNA, 24 nt, Artificial Sequence
  Synthetic
gcaaguacaaauauugacuauuua

SEQ ID NO: 20317 - RNA, 18 nt, Artificial Sequence
  Synthetic
gagcucauauuagugaac

SEQ ID NO: 20318 - RNA, 18 nt, Artificial Sequence
  Synthetic
gauacuaaaaaaaguuac

SEQ ID NO: 20319 - RNA, 19 nt, Artificial Sequence
  Synthetic
guauuagcaaguggacucc

SEQ ID NO: 20320 - RNA, 23 nt, Artificial Sequence
  Synthetic
gcacucuauuuagaguguauggc

SEQ ID NO: 20321 - RNA, 20 nt, Artificial Sequence
  Synthetic
gaaaaggcucuuuauaaugc

SEQ ID NO: 20322 - RNA, 19 nt, Artificial Sequence
  Synthetic
gcuaagagacuccugaauc

SEQ ID NO: 20323 - RNA, 23 nt, Artificial Sequence
  Synthetic
gucugcuaagagacuccugaauc

SEQ ID NO: 20324 - RNA, 24 nt, Artificial Sequence
  Synthetic
ggucugcuaagagacuccugaauc

SEQ ID NO: 20325 - RNA, 18 nt, Artificial Sequence
  Synthetic
guagaagaccuaaauauc

SEQ ID NO: 20326 - RNA, 21 nt, Artificial Sequence
  Synthetic
gauguagaagaccuaaauauc

SEQ ID NO: 20327 - RNA, 24 nt, Artificial Sequence
  Synthetic
gaagauguagaagaccuaaauauc

SEQ ID NO: 20328 - RNA, 18 nt, Artificial Sequence
  Synthetic
gggucugcuaagagacuc

SEQ ID NO: 20329 - RNA, 23 nt, Artificial Sequence
  Synthetic
gauuugggucugcuaagagacuc

SEQ ID NO: 20330 - RNA, 20 nt, Artificial Sequence
  Synthetic
gauauuuuucauuaugauuc

SEQ ID NO: 20331 - RNA, 18 nt, Artificial Sequence
  Synthetic
gauaaauaauugccuuuc

SEQ ID NO: 20332 - RNA, 24 nt, Artificial Sequence
  Synthetic
gauauugauaaauaauugccuuuc

SEQ ID NO: 20333 - RNA, 19 nt, Artificial Sequence
  Synthetic
guuggaugagggaaugcag

SEQ ID NO: 20334 - RNA, 20 nt, Artificial Sequence
  Synthetic
gguuggaugagggaaugcag

SEQ ID NO: 20335 - RNA, 22 nt, Artificial Sequence
  Synthetic
gaauugaucuugaagacauacg

SEQ ID NO: 20336 - RNA, 22 nt, Artificial Sequence
  Synthetic
gccuagaugauuauuaauaggg

SEQ ID NO: 20337 - RNA, 18 nt, Artificial Sequence
  Synthetic
guuaaguuguucuuaggg

SEQ ID NO: 20338 - RNA, 19 nt, Artificial Sequence
  Synthetic
gguuaaguuguucuuaggg

SEQ ID NO: 20339 - RNA, 23 nt, Artificial Sequence
  Synthetic
gccagguuaaguuguucuuaggg

SEQ ID NO: 20340 - RNA, 23 nt, Artificial Sequence
  Synthetic
guuaccuggauuggcuaccuugg

SEQ ID NO: 20341 - RNA, 18 nt, Artificial Sequence
  Synthetic
ggaaaugggguauaagug

SEQ ID NO: 20342 - RNA, 22 nt, Artificial Sequence
  Synthetic
gcuaauagcuuauucuauacau

SEQ ID NO: 20343 - RNA, 24 nt, Artificial Sequence
  Synthetic
gagcuaauagcuuauucuauacau

SEQ ID NO: 20344 - RNA, 23 nt, Artificial Sequence
  Synthetic
gaauaaugauguacauuuaauau

SEQ ID NO: 20345 - RNA, 20 nt, Artificial Sequence
  Synthetic
guaauggaaacacuauauau

SEQ ID NO: 20346 - RNA, 23 nt, Artificial Sequence
  Synthetic
guacauccaacuaacaucucuau

SEQ ID NO: 20347 - RNA, 21 nt, Artificial Sequence
  Synthetic
ggaaaauguuaaauuuucccu

SEQ ID NO: 20348 - RNA, 18 nt, Artificial Sequence
  Synthetic
gcacuuguugacaguccu

SEQ ID NO: 20349 - RNA, 19 nt, Artificial Sequence
  Synthetic
ggcacuuguugacaguccu

SEQ ID NO: 20350 - RNA, 23 nt, Artificial Sequence
  Synthetic
gcuaggcacuuguugacaguccu

SEQ ID NO: 20351 - RNA, 18 nt, Artificial Sequence
  Synthetic
gugcaaguccucugugcu

SEQ ID NO: 20352 - RNA, 18 nt, Artificial Sequence
  Synthetic
gccagguuaaguuguucu

SEQ ID NO: 20353 - RNA, 19 nt, Artificial Sequence
  Synthetic
gagggucucucuaaggugu

SEQ ID NO: 20354 - RNA, 21 nt, Artificial Sequence
  Synthetic
gugagggucucucuaaggugu

SEQ ID NO: 20355 - RNA, 22 nt, Artificial Sequence
  Synthetic
ggugagggucucucuaaggugu

SEQ ID NO: 20356 - RNA, 23 nt, Artificial Sequence
  Synthetic
gggugagggucucucuaaggugu

SEQ ID NO: 20357 - RNA, 24 nt, Artificial Sequence
  Synthetic
ggggugagggucucucuaaggugu

SEQ ID NO: 20358 - RNA, 18 nt, Artificial Sequence
  Synthetic
ggaaaucagcacucuauu

SEQ ID NO: 20359 - RNA, 19 nt, Artificial Sequence
  Synthetic
gggaaaucagcacucuauu

SEQ ID NO: 20360 - RNA, 20 nt, Artificial Sequence
  Synthetic
ggggaaaucagcacucuauu

SEQ ID NO: 20361 - RNA, 22 nt, Artificial Sequence
  Synthetic
guggggaaaucagcacucuauu

SEQ ID NO: 20362 - RNA, 18 nt, Artificial Sequence
  Synthetic
guaacucuuuauucacuu

SEQ ID NO: 20363 - RNA, 18 nt, Artificial Sequence
  Synthetic
gcuuucaggagccaaaaa

SEQ ID NO: 20364 - RNA, 19 nt, Artificial Sequence
  Synthetic
gauaagauucuaaaggaaa

SEQ ID NO: 20365 - RNA, 20 nt, Artificial Sequence
  Synthetic
ggauaagauucuaaaggaaa

SEQ ID NO: 20366 - RNA, 23 nt, Artificial Sequence
  Synthetic
gcuggauaagauucuaaaggaaa

SEQ ID NO: 20367 - RNA, 24 nt, Artificial Sequence
  Synthetic
ggcuggauaagauucuaaaggaaa

SEQ ID NO: 20368 - RNA, 23 nt, Artificial Sequence
  Synthetic
guacucaugccauacacucuaaa

SEQ ID NO: 20369 - RNA, 19 nt, Artificial Sequence
  Synthetic
gcuuugaaggaagauccaa

SEQ ID NO: 20370 - RNA, 21 nt, Artificial Sequence
  Synthetic
ggagaaccauauuuugaagaa

SEQ ID NO: 20371 - RNA, 23 nt, Artificial Sequence
  Synthetic
gaggagaaccauauuuugaagaa

SEQ ID NO: 20372 - RNA, 18 nt, Artificial Sequence
  Synthetic
ggguugauaagaagagaa

SEQ ID NO: 20373 - RNA, 24 nt, Artificial Sequence
  Synthetic
gaaagaggguugauaagaagagaa

SEQ ID NO: 20374 - RNA, 23 nt, Artificial Sequence
  Synthetic
guacuugcucucugaccacauaa

SEQ ID NO: 20375 - RNA, 19 nt, Artificial Sequence
  Synthetic
guauaugauauacucuuaa

SEQ ID NO: 20376 - RNA, 22 nt, Artificial Sequence
  Synthetic
gauguauaugauauacucuuaa

SEQ ID NO: 20377 - RNA, 23 nt, Artificial Sequence
  Synthetic
ggauguauaugauauacucuuaa

SEQ ID NO: 20378 - RNA, 18 nt, Artificial Sequence
  Synthetic
guauagaauuuugcauca

SEQ ID NO: 20379 - RNA, 18 nt, Artificial Sequence
  Synthetic
gguaguaauuguguuuca

SEQ ID NO: 20380 - RNA, 23 nt, Artificial Sequence
  Synthetic
gaaaagguaguaauuguguuuca

SEQ ID NO: 20381 - RNA, 20 nt, Artificial Sequence
  Synthetic
gaucuagcuaaaauauaaga

SEQ ID NO: 20382 - RNA, 18 nt, Artificial Sequence
  Synthetic
gauuccaagcuuucugga

SEQ ID NO: 20383 - RNA, 20 nt, Artificial Sequence
  Synthetic
gauauacucuuaagugaaua

SEQ ID NO: 20384 - RNA, 20 nt, Artificial Sequence
  Synthetic
gauggauauucuaugauaua

SEQ ID NO: 20385 - RNA, 21 nt, Artificial Sequence
  Synthetic
ggauggauauucuaugauaua

SEQ ID NO: 20386 - RNA, 20 nt, Artificial Sequence
  Synthetic
guuuuugcuugcuuuuuaua

SEQ ID NO: 20387 - RNA, 19 nt, Artificial Sequence
  Synthetic
gucugagaagacaaagcua

SEQ ID NO: 20388 - RNA, 19 nt, Artificial Sequence
  Synthetic
guaaucggcgguggaggua

SEQ ID NO: 20389 - RNA, 22 nt, Artificial Sequence
  Synthetic
gaaguaaucggcgguggaggua

SEQ ID NO: 20390 - RNA, 24 nt, Artificial Sequence
  Synthetic
gagaaguaaucggcgguggaggua

SEQ ID NO: 20391 - RNA, 21 nt, Artificial Sequence
  Synthetic
gaucauugccucacuauggua

SEQ ID NO: 20392 - RNA, 23 nt, Artificial Sequence
  Synthetic
guaauaacugggacucauaugua

SEQ ID NO: 20393 - RNA, 18 nt, Artificial Sequence
  Synthetic
gaagauccaauaggauua

SEQ ID NO: 20394 - RNA, 19 nt, Artificial Sequence
  Synthetic
ggaagauccaauaggauua

SEQ ID NO: 20395 - RNA, 22 nt, Artificial Sequence
  Synthetic
gaaggaagauccaauaggauua

SEQ ID NO: 20396 - RNA, 18 nt, Artificial Sequence
  Synthetic
gcaggaggugagggauua

SEQ ID NO: 20397 - RNA, 18 nt, Artificial Sequence
  Synthetic
guuagcaauggucuaaac

SEQ ID NO: 20398 - RNA, 19 nt, Artificial Sequence
  Synthetic
gauucuguuuaaauagcac

SEQ ID NO: 20399 - RNA, 18 nt, Artificial Sequence
  Synthetic
gagaaggucaaacuugac

SEQ ID NO: 20400 - RNA, 21 nt, Artificial Sequence
  Synthetic
guagagaaggucaaacuugac

SEQ ID NO: 20401 - RNA, 23 nt, Artificial Sequence
  Synthetic
gccuuauucuuuugauauacucc

SEQ ID NO: 20402 - RNA, 22 nt, Artificial Sequence
  Synthetic
gucuugcgcuuaugaaacuucc

SEQ ID NO: 20403 - RNA, 19 nt, Artificial Sequence
  Synthetic
gcuuuuaaaacaaaauagc

SEQ ID NO: 20404 - RNA, 18 nt, Artificial Sequence
  Synthetic
ggaagacagcuggcuauc

SEQ ID NO: 20405 - RNA, 21 nt, Artificial Sequence
  Synthetic
gcaggaagacagcuggcuauc

SEQ ID NO: 20406 - RNA, 18 nt, Artificial Sequence
  Synthetic
gcuggcuauccaggauuc

SEQ ID NO: 20407 - RNA, 22 nt, Artificial Sequence
  Synthetic
gacagcuggcuauccaggauuc

SEQ ID NO: 20408 - RNA, 19 nt, Artificial Sequence
  Synthetic
guucuguaauuuuugcuuc

SEQ ID NO: 20409 - RNA, 20 nt, Artificial Sequence
  Synthetic
gguucuguaauuuuugcuuc

SEQ ID NO: 20410 - RNA, 18 nt, Artificial Sequence
  Synthetic
gacuuuguagugaucuuc

SEQ ID NO: 20411 - RNA, 21 nt, Artificial Sequence
  Synthetic
gaagacuuuguagugaucuuc

SEQ ID NO: 20412 - RNA, 23 nt, Artificial Sequence
  Synthetic
gagaagacuuuguagugaucuuc

SEQ ID NO: 20413 - RNA, 24 nt, Artificial Sequence
  Synthetic
ggagaagacuuuguagugaucuuc

SEQ ID NO: 20414 - RNA, 18 nt, Artificial Sequence
  Synthetic
gcuuuucaaaauacuuuc

SEQ ID NO: 20415 - RNA, 21 nt, Artificial Sequence
  Synthetic
gaagcuuuucaaaauacuuuc

SEQ ID NO: 20416 - RNA, 20 nt, Artificial Sequence
  Synthetic
guaacaguacaagaaaaaag

SEQ ID NO: 20417 - RNA, 21 nt, Artificial Sequence
  Synthetic
ggcauaugagaaaagucacag

SEQ ID NO: 20418 - RNA, 22 nt, Artificial Sequence
  Synthetic
gaacccaacugaugucaagcag

SEQ ID NO: 20419 - RNA, 23 nt, Artificial Sequence
  Synthetic
ggaacccaacugaugucaagcag

SEQ ID NO: 20420 - RNA, 18 nt, Artificial Sequence
  Synthetic
guauuagagguuaaggag

SEQ ID NO: 20421 - RNA, 18 nt, Artificial Sequence
  Synthetic
gucuuuuccucuuaauag

SEQ ID NO: 20422 - RNA, 21 nt, Artificial Sequence
  Synthetic
gaagucuuuuccucuuaauag

SEQ ID NO: 20423 - RNA, 18 nt, Artificial Sequence
  Synthetic
gaaaagcagcuaugaagg

SEQ ID NO: 20424 - RNA, 24 nt, Artificial Sequence
  Synthetic
gcuuaugaaaagcagcuaugaagg

SEQ ID NO: 20425 - RNA, 18 nt, Artificial Sequence
  Synthetic
ggcauagaguaagacagg

SEQ ID NO: 20426 - RNA, 21 nt, Artificial Sequence
  Synthetic
gcuggcauagaguaagacagg

SEQ ID NO: 20427 - RNA, 22 nt, Artificial Sequence
  Synthetic
ggcuggcauagaguaagacagg

SEQ ID NO: 20428 - RNA, 24 nt, Artificial Sequence
  Synthetic
gaggcuggcauagaguaagacagg

SEQ ID NO: 20429 - RNA, 18 nt, Artificial Sequence
  Synthetic
gguagugugaagaugggg

SEQ ID NO: 20430 - RNA, 21 nt, Artificial Sequence
  Synthetic
gcugguagugugaagaugggg

SEQ ID NO: 20431 - RNA, 22 nt, Artificial Sequence
  Synthetic
ggcugguagugugaagaugggg

SEQ ID NO: 20432 - RNA, 23 nt, Artificial Sequence
  Synthetic
gggcugguagugugaagaugggg

SEQ ID NO: 20433 - RNA, 24 nt, Artificial Sequence
  Synthetic
ggggcugguagugugaagaugggg

SEQ ID NO: 20434 - RNA, 18 nt, Artificial Sequence
  Synthetic
gggaaugcagacucuggg

SEQ ID NO: 20435 - RNA, 23 nt, Artificial Sequence
  Synthetic
gauuagggaaugcagacucuggg

SEQ ID NO: 20436 - RNA, 24 nt, Artificial Sequence
  Synthetic
ggauuagggaaugcagacucuggg

SEQ ID NO: 20437 - RNA, 18 nt, Artificial Sequence
  Synthetic
gggggagccccauaaaug

SEQ ID NO: 20438 - RNA, 20 nt, Artificial Sequence
  Synthetic
gugggggagccccauaaaug

SEQ ID NO: 20439 - RNA, 19 nt, Artificial Sequence
  Synthetic
gugagauuagaggccacug

SEQ ID NO: 20440 - RNA, 20 nt, Artificial Sequence
  Synthetic
ggugagauuagaggccacug

SEQ ID NO: 20441 - RNA, 18 nt, Artificial Sequence
  Synthetic
gcacauauguucagacug

SEQ ID NO: 20442 - RNA, 23 nt, Artificial Sequence
  Synthetic
gacuugcacauauguucagacug

SEQ ID NO: 20443 - RNA, 24 nt, Artificial Sequence
  Synthetic
ggacuugcacauauguucagacug

SEQ ID NO: 20444 - RNA, 18 nt, Artificial Sequence
  Synthetic
gcaucucaccagugugug

SEQ ID NO: 20445 - RNA, 19 nt, Artificial Sequence
  Synthetic
ggcaucucaccagugugug

SEQ ID NO: 20446 - RNA, 18 nt, Artificial Sequence
  Synthetic
gaggagaaccauauuuug

SEQ ID NO: 20447 - RNA, 21 nt, Artificial Sequence
  Synthetic
gaugaggagaaccauauuuug

SEQ ID NO: 20448 - RNA, 21 nt, Artificial Sequence
  Synthetic
gccccauaaauguugaauaau

SEQ ID NO: 20449 - RNA, 23 nt, Artificial Sequence
  Synthetic
gagccccauaaauguugaauaau

SEQ ID NO: 20450 - RNA, 24 nt, Artificial Sequence
  Synthetic
ggagccccauaaauguugaauaau

SEQ ID NO: 20451 - RNA, 18 nt, Artificial Sequence
  Synthetic
gauuuuuucccauguaau

SEQ ID NO: 20452 - RNA, 20 nt, Artificial Sequence
  Synthetic
gaaucacuauugauugacau

SEQ ID NO: 20453 - RNA, 19 nt, Artificial Sequence
  Synthetic
guaguuucuauuaauagau

SEQ ID NO: 20454 - RNA, 21 nt, Artificial Sequence
  Synthetic
guguaguuucuauuaauagau

SEQ ID NO: 20455 - RNA, 18 nt, Artificial Sequence
  Synthetic
gaaagagcuuucuaguau

SEQ ID NO: 20456 - RNA, 20 nt, Artificial Sequence
  Synthetic
gagaaagagcuuucuaguau

SEQ ID NO: 20457 - RNA, 21 nt, Artificial Sequence
  Synthetic
guucaaauuauuucuacugcu

SEQ ID NO: 20458 - RNA, 24 nt, Artificial Sequence
  Synthetic
guuguucaaauuauuucuacugcu

SEQ ID NO: 20459 - RNA, 22 nt, Artificial Sequence
  Synthetic
guaaagacuaaggcuuauuucu

SEQ ID NO: 20460 - RNA, 21 nt, Artificial Sequence
  Synthetic
gauaagaagagaaaggggugu

SEQ ID NO: 20461 - RNA, 24 nt, Artificial Sequence
  Synthetic
guugauaagaagagaaaggggugu

SEQ ID NO: 20462 - RNA, 18 nt, Artificial Sequence
  Synthetic
guuguuaucucugaaauu

SEQ ID NO: 20463 - RNA, 24 nt, Artificial Sequence
  Synthetic
gcuauuacgguaagcucaagcauu

SEQ ID NO: 20464 - RNA, 19 nt, Artificial Sequence
  Synthetic
gcugccuuuuaguaguauu

SEQ ID NO: 20465 - RNA, 22 nt, Artificial Sequence
  Synthetic
gaggcugccuuuuaguaguauu

SEQ ID NO: 20466 - RNA, 23 nt, Artificial Sequence
  Synthetic
ggaggcugccuuuuaguaguauu

SEQ ID NO: 20467 - RNA, 22 nt, Artificial Sequence
  Synthetic
gaauagauuagcuuauauacuu

SEQ ID NO: 20468 - RNA, 24 nt, Artificial Sequence
  Synthetic
guuagaggaaggcaguggucccuu

SEQ ID NO: 20469 - RNA, 18 nt, Artificial Sequence
  Synthetic
gaugugcaaaaauagcuu

SEQ ID NO: 20470 - RNA, 22 nt, Artificial Sequence
  Synthetic
gauagaugugcaaaaauagcuu

SEQ ID NO: 20471 - RNA, 21 nt, Artificial Sequence
  Synthetic
guuacaugaccuuccuuucuu

SEQ ID NO: 20472 - RNA, 20 nt, Artificial Sequence
  Synthetic
gauaaugggagaaacagguu

SEQ ID NO: 20473 - RNA, 18 nt, Artificial Sequence
  Synthetic
gcacuggaguuaccuguu

SEQ ID NO: 20474 - RNA, 22 nt, Artificial Sequence
  Synthetic
gcaaauaguuuuaucaauauuu

SEQ ID NO: 20475 - RNA, 21 nt, Artificial Sequence
  Synthetic
guuuuggauggagcuugguuu

SEQ ID NO: 20476 - RNA, 22 nt, Artificial Sequence
  Synthetic
gguuuuggauggagcuugguuu

SEQ ID NO: 20477 - RNA, 18 nt, Artificial Sequence
  Synthetic
guccuccacaaauauuuu

SEQ ID NO: 20478 - RNA, 18 nt, Artificial Sequence
  Synthetic
cauaugauuuuaugaaaa

SEQ ID NO: 20479 - RNA, 19 nt, Artificial Sequence
  Synthetic
acauaugauuuuaugaaaa

SEQ ID NO: 20480 - RNA, 20 nt, Artificial Sequence
  Synthetic
uacauaugauuuuaugaaaa

SEQ ID NO: 20481 - RNA, 18 nt, Artificial Sequence
  Synthetic
uaauacuacugacuaaaa

SEQ ID NO: 20482 - RNA, 19 nt, Artificial Sequence
  Synthetic
auaauacuacugacuaaaa

SEQ ID NO: 20483 - RNA, 18 nt, Artificial Sequence
  Synthetic
acuccagugcuauuuaaa

SEQ ID NO: 20484 - RNA, 19 nt, Artificial Sequence
  Synthetic
aacuccagugcuauuuaaa

SEQ ID NO: 20485 - RNA, 20 nt, Artificial Sequence
  Synthetic
uaacuccagugcuauuuaaa

SEQ ID NO: 20486 - RNA, 23 nt, Artificial Sequence
  Synthetic
agguaacuccagugcuauuuaaa

SEQ ID NO: 20487 - RNA, 24 nt, Artificial Sequence
  Synthetic
cagguaacuccagugcuauuuaaa

SEQ ID NO: 20488 - RNA, 18 nt, Artificial Sequence
  Synthetic
acuccaggaguauaucaa

SEQ ID NO: 20489 - RNA, 21 nt, Artificial Sequence
  Synthetic
uggacuccaggaguauaucaa

SEQ ID NO: 20490 - RNA, 23 nt, Artificial Sequence
  Synthetic
aguggacuccaggaguauaucaa

SEQ ID NO: 20491 - RNA, 24 nt, Artificial Sequence
  Synthetic
aaguggacuccaggaguauaucaa

SEQ ID NO: 20492 - RNA, 18 nt, Artificial Sequence
  Synthetic
augagagacaguaaagaa

SEQ ID NO: 20493 - RNA, 18 nt, Artificial Sequence
  Synthetic
agggugggauauggagaa

SEQ ID NO: 20494 - RNA, 19 nt, Artificial Sequence
  Synthetic
uagggugggauauggagaa

SEQ ID NO: 20495 - RNA, 20 nt, Artificial Sequence
  Synthetic
uuagggugggauauggagaa

SEQ ID NO: 20496 - RNA, 18 nt, Artificial Sequence
  Synthetic
uuuaccauuaucuacaca

SEQ ID NO: 20497 - RNA, 19 nt, Artificial Sequence
  Synthetic
uuuuaccauuaucuacaca

SEQ ID NO: 20498 - RNA, 20 nt, Artificial Sequence
  Synthetic
uuuuuaccauuaucuacaca

SEQ ID NO: 20499 - RNA, 18 nt, Artificial Sequence
  Synthetic
uagugaacuagagucaca

SEQ ID NO: 20500 - RNA, 19 nt, Artificial Sequence
  Synthetic
uuagugaacuagagucaca

SEQ ID NO: 20501 - RNA, 20 nt, Artificial Sequence
  Synthetic
auuagugaacuagagucaca

SEQ ID NO: 20502 - RNA, 21 nt, Artificial Sequence
  Synthetic
uauuagugaacuagagucaca

SEQ ID NO: 20503 - RNA, 22 nt, Artificial Sequence
  Synthetic
auauuagugaacuagagucaca

SEQ ID NO: 20504 - RNA, 23 nt, Artificial Sequence
  Synthetic
cauauuagugaacuagagucaca

SEQ ID NO: 20505 - RNA, 24 nt, Artificial Sequence
  Synthetic
ucauauuagugaacuagagucaca

SEQ ID NO: 20506 - RNA, 18 nt, Artificial Sequence
  Synthetic
uggagaagaggaugacca

SEQ ID NO: 20507 - RNA, 19 nt, Artificial Sequence
  Synthetic
auggagaagaggaugacca

SEQ ID NO: 20508 - RNA, 20 nt, Artificial Sequence
  Synthetic
uauggagaagaggaugacca

SEQ ID NO: 20509 - RNA, 18 nt, Artificial Sequence
  Synthetic
agagacacaccuaaagca

SEQ ID NO: 20510 - RNA, 19 nt, Artificial Sequence
  Synthetic
aagagacacaccuaaagca

SEQ ID NO: 20511 - RNA, 20 nt, Artificial Sequence
  Synthetic
aaagagacacaccuaaagca

SEQ ID NO: 20512 - RNA, 18 nt, Artificial Sequence
  Synthetic
uagugauucauuauauca

SEQ ID NO: 20513 - RNA, 19 nt, Artificial Sequence
  Synthetic
auagugauucauuauauca

SEQ ID NO: 20514 - RNA, 20 nt, Artificial Sequence
  Synthetic
aauagugauucauuauauca

SEQ ID NO: 20515 - RNA, 18 nt, Artificial Sequence
  Synthetic
auuuuugcacaucuauca

SEQ ID NO: 20516 - RNA, 19 nt, Artificial Sequence
  Synthetic
uauuuuugcacaucuauca

SEQ ID NO: 20517 - RNA, 20 nt, Artificial Sequence
  Synthetic
cuauuuuugcacaucuauca

SEQ ID NO: 20518 - RNA, 22 nt, Artificial Sequence
  Synthetic
agcuauuuuugcacaucuauca

SEQ ID NO: 20519 - RNA, 23 nt, Artificial Sequence
  Synthetic
aagcuauuuuugcacaucuauca

SEQ ID NO: 20520 - RNA, 24 nt, Artificial Sequence
  Synthetic
aaagcuauuuuugcacaucuauca

SEQ ID NO: 20521 - RNA, 18 nt, Artificial Sequence
  Synthetic
aaaaggcagccuccuaga

SEQ ID NO: 20522 - RNA, 19 nt, Artificial Sequence
  Synthetic
uaaaaggcagccuccuaga

SEQ ID NO: 20523 - RNA, 20 nt, Artificial Sequence
  Synthetic
cuaaaaggcagccuccuaga

SEQ ID NO: 20524 - RNA, 21 nt, Artificial Sequence
  Synthetic
uuggcuaccuugguuggauga

SEQ ID NO: 20525 - RNA, 22 nt, Artificial Sequence
  Synthetic
auuggcuaccuugguuggauga

SEQ ID NO: 20526 - RNA, 19 nt, Artificial Sequence
  Synthetic
agaauauccauccauauga

SEQ ID NO: 20527 - RNA, 20 nt, Artificial Sequence
  Synthetic
uagaauauccauccauauga

SEQ ID NO: 20528 - RNA, 21 nt, Artificial Sequence
  Synthetic
auagaauauccauccauauga

SEQ ID NO: 20529 - RNA, 22 nt, Artificial Sequence
  Synthetic
cauagaauauccauccauauga

SEQ ID NO: 20530 - RNA, 23 nt, Artificial Sequence
  Synthetic
ucauagaauauccauccauauga

SEQ ID NO: 20531 - RNA, 24 nt, Artificial Sequence
  Synthetic
aucauagaauauccauccauauga

SEQ ID NO: 20532 - RNA, 18 nt, Artificial Sequence
  Synthetic
auuaccaaauuguauuga

SEQ ID NO: 20533 - RNA, 19 nt, Artificial Sequence
  Synthetic
aauuaccaaauuguauuga

SEQ ID NO: 20534 - RNA, 20 nt, Artificial Sequence
  Synthetic
aaauuaccaaauuguauuga

SEQ ID NO: 20535 - RNA, 18 nt, Artificial Sequence
  Synthetic
aaaauuacagaaccuaua

SEQ ID NO: 20536 - RNA, 19 nt, Artificial Sequence
  Synthetic
aaaaauuacagaaccuaua

SEQ ID NO: 20537 - RNA, 19 nt, Artificial Sequence
  Synthetic
uguuacaacagucuuuaua

SEQ ID NO: 20538 - RNA, 20 nt, Artificial Sequence
  Synthetic
uuguuacaacagucuuuaua

SEQ ID NO: 20539 - RNA, 18 nt, Artificial Sequence
  Synthetic
uccucccuugucucccua

SEQ ID NO: 20540 - RNA, 19 nt, Artificial Sequence
  Synthetic
uuccucccuugucucccua

SEQ ID NO: 20541 - RNA, 20 nt, Artificial Sequence
  Synthetic
cuuccucccuugucucccua

SEQ ID NO: 20542 - RNA, 18 nt, Artificial Sequence
  Synthetic
acuuauccauuaauccua

SEQ ID NO: 20543 - RNA, 19 nt, Artificial Sequence
  Synthetic
aacuuauccauuaauccua

SEQ ID NO: 20544 - RNA, 20 nt, Artificial Sequence
  Synthetic
caacuuauccauuaauccua

SEQ ID NO: 20545 - RNA, 21 nt, Artificial Sequence
  Synthetic
ucaacuuauccauuaauccua

SEQ ID NO: 20546 - RNA, 22 nt, Artificial Sequence
  Synthetic
uucaacuuauccauuaauccua

SEQ ID NO: 20547 - RNA, 24 nt, Artificial Sequence
  Synthetic
uguucaacuuauccauuaauccua

SEQ ID NO: 20548 - RNA, 18 nt, Artificial Sequence
  Synthetic
acaaauuaccaaauugua

SEQ ID NO: 20549 - RNA, 19 nt, Artificial Sequence
  Synthetic
uacaaauuaccaaauugua

SEQ ID NO: 20550 - RNA, 20 nt, Artificial Sequence
  Synthetic
auacaaauuaccaaauugua

SEQ ID NO: 20551 - RNA, 22 nt, Artificial Sequence
  Synthetic
ugauacaaauuaccaaauugua

SEQ ID NO: 20552 - RNA, 23 nt, Artificial Sequence
  Synthetic
cugauacaaauuaccaaauugua

SEQ ID NO: 20553 - RNA, 24 nt, Artificial Sequence
  Synthetic
ucugauacaaauuaccaaauugua

SEQ ID NO: 20554 - RNA, 18 nt, Artificial Sequence
  Synthetic
agccugacaccaaauuua

SEQ ID NO: 20555 - RNA, 19 nt, Artificial Sequence
  Synthetic
cagccugacaccaaauuua

SEQ ID NO: 20556 - RNA, 20 nt, Artificial Sequence
  Synthetic
ccagccugacaccaaauuua

SEQ ID NO: 20557 - RNA, 21 nt, Artificial Sequence
  Synthetic
cccagccugacaccaaauuua

SEQ ID NO: 20558 - RNA, 22 nt, Artificial Sequence
  Synthetic
acccagccugacaccaaauuua

SEQ ID NO: 20559 - RNA, 23 nt, Artificial Sequence
  Synthetic
cacccagccugacaccaaauuua

SEQ ID NO: 20560 - RNA, 18 nt, Artificial Sequence
  Synthetic
acaaauauugacuauuua

SEQ ID NO: 20561 - RNA, 19 nt, Artificial Sequence
  Synthetic
uacaaauauugacuauuua

SEQ ID NO: 20562 - RNA, 21 nt, Artificial Sequence
  Synthetic
aguacaaauauugacuauuua

SEQ ID NO: 20563 - RNA, 22 nt, Artificial Sequence
  Synthetic
aaguacaaauauugacuauuua

SEQ ID NO: 20564 - RNA, 23 nt, Artificial Sequence
  Synthetic
caaguacaaauauugacuauuua

SEQ ID NO: 20565 - RNA, 19 nt, Artificial Sequence
  Synthetic
agagcucauauuagugaac

SEQ ID NO: 20566 - RNA, 20 nt, Artificial Sequence
  Synthetic
cagagcucauauuagugaac

SEQ ID NO: 20567 - RNA, 21 nt, Artificial Sequence
  Synthetic
ucagagcucauauuagugaac

SEQ ID NO: 20568 - RNA, 22 nt, Artificial Sequence
  Synthetic
aucagagcucauauuagugaac

SEQ ID NO: 20569 - RNA, 23 nt, Artificial Sequence
  Synthetic
uaucagagcucauauuagugaac

SEQ ID NO: 20570 - RNA, 24 nt, Artificial Sequence
  Synthetic
uuaucagagcucauauuagugaac

SEQ ID NO: 20571 - RNA, 18 nt, Artificial Sequence
  Synthetic
ucuauuaauagaaacuac

SEQ ID NO: 20572 - RNA, 19 nt, Artificial Sequence
  Synthetic
aucuauuaauagaaacuac

SEQ ID NO: 20573 - RNA, 20 nt, Artificial Sequence
  Synthetic
aaucuauuaauagaaacuac

SEQ ID NO: 20574 - RNA, 21 nt, Artificial Sequence
  Synthetic
uaaucuauuaauagaaacuac

SEQ ID NO: 20575 - RNA, 22 nt, Artificial Sequence
  Synthetic
cuaaucuauuaauagaaacuac

SEQ ID NO: 20576 - RNA, 23 nt, Artificial Sequence
  Synthetic
ucuaaucuauuaauagaaacuac

SEQ ID NO: 20577 - RNA, 24 nt, Artificial Sequence
  Synthetic
cucuaaucuauuaauagaaacuac

SEQ ID NO: 20578 - RNA, 18 nt, Artificial Sequence
  Synthetic
uacuacuuccacuacuac

SEQ ID NO: 20579 - RNA, 19 nt, Artificial Sequence
  Synthetic
auacuacuuccacuacuac

SEQ ID NO: 20580 - RNA, 20 nt, Artificial Sequence
  Synthetic
uauacuacuuccacuacuac

SEQ ID NO: 20581 - RNA, 21 nt, Artificial Sequence
  Synthetic
cuauacuacuuccacuacuac

SEQ ID NO: 20582 - RNA, 22 nt, Artificial Sequence
  Synthetic
acuauacuacuuccacuacuac

SEQ ID NO: 20583 - RNA, 23 nt, Artificial Sequence
  Synthetic
uacuauacuacuuccacuacuac

SEQ ID NO: 20584 - RNA, 24 nt, Artificial Sequence
  Synthetic
cuacuauacuacuuccacuacuac

SEQ ID NO: 20585 - RNA, 18 nt, Artificial Sequence
  Synthetic
augagucccaguuauuac

SEQ ID NO: 20586 - RNA, 19 nt, Artificial Sequence
  Synthetic
uaugagucccaguuauuac

SEQ ID NO: 20587 - RNA, 20 nt, Artificial Sequence
  Synthetic
auaugagucccaguuauuac

SEQ ID NO: 20588 - RNA, 21 nt, Artificial Sequence
  Synthetic
cauaugagucccaguuauuac

SEQ ID NO: 20589 - RNA, 22 nt, Artificial Sequence
  Synthetic
acauaugagucccaguuauuac

SEQ ID NO: 20590 - RNA, 23 nt, Artificial Sequence
  Synthetic
uacauaugagucccaguuauuac

SEQ ID NO: 20591 - RNA, 24 nt, Artificial Sequence
  Synthetic
auacauaugagucccaguuauuac

SEQ ID NO: 20592 - RNA, 19 nt, Artificial Sequence
  Synthetic
agauacuaaaaaaaguuac

SEQ ID NO: 20593 - RNA, 20 nt, Artificial Sequence
  Synthetic
aagauacuaaaaaaaguuac

SEQ ID NO: 20594 - RNA, 18 nt, Artificial Sequence
  Synthetic
uauuagcaaguggacucc

SEQ ID NO: 20595 - RNA, 21 nt, Artificial Sequence
  Synthetic
uuguauuagcaaguggacucc

SEQ ID NO: 20596 - RNA, 22 nt, Artificial Sequence
  Synthetic
auuguauuagcaaguggacucc

SEQ ID NO: 20597 - RNA, 23 nt, Artificial Sequence
  Synthetic
aauuguauuagcaaguggacucc

SEQ ID NO: 20598 - RNA, 24 nt, Artificial Sequence
  Synthetic
caauuguauuagcaaguggacucc

SEQ ID NO: 20599 - RNA, 18 nt, Artificial Sequence
  Synthetic
ugagccuaucaccuaggc

SEQ ID NO: 20600 - RNA, 19 nt, Artificial Sequence
  Synthetic
uugagccuaucaccuaggc

SEQ ID NO: 20601 - RNA, 20 nt, Artificial Sequence
  Synthetic
uuugagccuaucaccuaggc

SEQ ID NO: 20602 - RNA, 18 nt, Artificial Sequence
  Synthetic
cuauuuagaguguauggc

SEQ ID NO: 20603 - RNA, 19 nt, Artificial Sequence
  Synthetic
ucuauuuagaguguauggc

SEQ ID NO: 20604 - RNA, 20 nt, Artificial Sequence
  Synthetic
cucuauuuagaguguauggc

SEQ ID NO: 20605 - RNA, 21 nt, Artificial Sequence
  Synthetic
acucuauuuagaguguauggc

SEQ ID NO: 20606 - RNA, 22 nt, Artificial Sequence
  Synthetic
cacucuauuuagaguguauggc

SEQ ID NO: 20607 - RNA, 24 nt, Artificial Sequence
  Synthetic
agcacucuauuuagaguguauggc

SEQ ID NO: 20608 - RNA, 18 nt, Artificial Sequence
  Synthetic
aaaggcucuuuauaaugc

SEQ ID NO: 20609 - RNA, 19 nt, Artificial Sequence
  Synthetic
aaaaggcucuuuauaaugc

SEQ ID NO: 20610 - RNA, 21 nt, Artificial Sequence
  Synthetic
agaaaaggcucuuuauaaugc

SEQ ID NO: 20611 - RNA, 22 nt, Artificial Sequence
  Synthetic
aagaaaaggcucuuuauaaugc

SEQ ID NO: 20612 - RNA, 23 nt, Artificial Sequence
  Synthetic
aaagaaaaggcucuuuauaaugc

SEQ ID NO: 20613 - RNA, 24 nt, Artificial Sequence
  Synthetic
aaaagaaaaggcucuuuauaaugc

SEQ ID NO: 20614 - RNA, 18 nt, Artificial Sequence
  Synthetic
cuaagagacuccugaauc

SEQ ID NO: 20615 - RNA, 20 nt, Artificial Sequence
  Synthetic
ugcuaagagacuccugaauc

SEQ ID NO: 20616 - RNA, 21 nt, Artificial Sequence
  Synthetic
cugcuaagagacuccugaauc

SEQ ID NO: 20617 - RNA, 22 nt, Artificial Sequence
  Synthetic
ucugcuaagagacuccugaauc

SEQ ID NO: 20618 - RNA, 19 nt, Artificial Sequence
  Synthetic
uguagaagaccuaaauauc

SEQ ID NO: 20619 - RNA, 20 nt, Artificial Sequence
  Synthetic
auguagaagaccuaaauauc

SEQ ID NO: 20620 - RNA, 22 nt, Artificial Sequence
  Synthetic
agauguagaagaccuaaauauc

SEQ ID NO: 20621 - RNA, 23 nt, Artificial Sequence
  Synthetic
aagauguagaagaccuaaauauc

SEQ ID NO: 20622 - RNA, 19 nt, Artificial Sequence
  Synthetic
ugggucugcuaagagacuc

SEQ ID NO: 20623 - RNA, 20 nt, Artificial Sequence
  Synthetic
uugggucugcuaagagacuc

SEQ ID NO: 20624 - RNA, 21 nt, Artificial Sequence
  Synthetic
uuugggucugcuaagagacuc

SEQ ID NO: 20625 - RNA, 22 nt, Artificial Sequence
  Synthetic
auuugggucugcuaagagacuc

SEQ ID NO: 20626 - RNA, 24 nt, Artificial Sequence
  Synthetic
agauuugggucugcuaagagacuc

SEQ ID NO: 20627 - RNA, 21 nt, Artificial Sequence
  Synthetic
uacuauugcuuucauuaaguc

SEQ ID NO: 20628 - RNA, 22 nt, Artificial Sequence
  Synthetic
cuacuauugcuuucauuaaguc

SEQ ID NO: 20629 - RNA, 23 nt, Artificial Sequence
  Synthetic
ucuacuauugcuuucauuaaguc

SEQ ID NO: 20630 - RNA, 24 nt, Artificial Sequence
  Synthetic
cucuacuauugcuuucauuaaguc

SEQ ID NO: 20631 - RNA, 18 nt, Artificial Sequence
  Synthetic
uagagacaaggugguguc

SEQ ID NO: 20632 - RNA, 19 nt, Artificial Sequence
  Synthetic
auagagacaaggugguguc

SEQ ID NO: 20633 - RNA, 21 nt, Artificial Sequence
  Synthetic
uaauagagacaaggugguguc

SEQ ID NO: 20634 - RNA, 22 nt, Artificial Sequence
  Synthetic
auaauagagacaaggugguguc

SEQ ID NO: 20635 - RNA, 23 nt, Artificial Sequence
  Synthetic
aauaauagagacaaggugguguc

SEQ ID NO: 20636 - RNA, 24 nt, Artificial Sequence
  Synthetic
caauaauagagacaaggugguguc

SEQ ID NO: 20637 - RNA, 18 nt, Artificial Sequence
  Synthetic
uauuuuucauuaugauuc

SEQ ID NO: 20638 - RNA, 19 nt, Artificial Sequence
  Synthetic
auauuuuucauuaugauuc

SEQ ID NO: 20639 - RNA, 18 nt, Artificial Sequence
  Synthetic
uugacaucaguuggguuc

SEQ ID NO: 20640 - RNA, 19 nt, Artificial Sequence
  Synthetic
cuugacaucaguuggguuc

SEQ ID NO: 20641 - RNA, 21 nt, Artificial Sequence
  Synthetic
ugcuugacaucaguuggguuc

SEQ ID NO: 20642 - RNA, 22 nt, Artificial Sequence
  Synthetic
cugcuugacaucaguuggguuc

SEQ ID NO: 20643 - RNA, 23 nt, Artificial Sequence
  Synthetic
ucugcuugacaucaguuggguuc

SEQ ID NO: 20644 - RNA, 24 nt, Artificial Sequence
  Synthetic
uucugcuugacaucaguuggguuc

SEQ ID NO: 20645 - RNA, 19 nt, Artificial Sequence
  Synthetic
ugauaaauaauugccuuuc

SEQ ID NO: 20646 - RNA, 21 nt, Artificial Sequence
  Synthetic
auugauaaauaauugccuuuc

SEQ ID NO: 20647 - RNA, 22 nt, Artificial Sequence
  Synthetic
uauugauaaauaauugccuuuc

SEQ ID NO: 20648 - RNA, 23 nt, Artificial Sequence
  Synthetic
auauugauaaauaauugccuuuc

SEQ ID NO: 20649 - RNA, 18 nt, Artificial Sequence
  Synthetic
uuggaugagggaaugcag

SEQ ID NO: 20650 - RNA, 21 nt, Artificial Sequence
  Synthetic
ugguuggaugagggaaugcag

SEQ ID NO: 20651 - RNA, 22 nt, Artificial Sequence
  Synthetic
uugguuggaugagggaaugcag

SEQ ID NO: 20652 - RNA, 23 nt, Artificial Sequence
  Synthetic
cuugguuggaugagggaaugcag

SEQ ID NO: 20653 - RNA, 24 nt, Artificial Sequence
  Synthetic
ccuugguuggaugagggaaugcag

SEQ ID NO: 20654 - RNA, 18 nt, Artificial Sequence
  Synthetic
ccuucugcuugacaucag

SEQ ID NO: 20655 - RNA, 19 nt, Artificial Sequence
  Synthetic
cccuucugcuugacaucag

SEQ ID NO: 20656 - RNA, 20 nt, Artificial Sequence
  Synthetic
acccuucugcuugacaucag

SEQ ID NO: 20657 - RNA, 21 nt, Artificial Sequence
  Synthetic
cacccuucugcuugacaucag

SEQ ID NO: 20658 - RNA, 22 nt, Artificial Sequence
  Synthetic
acacccuucugcuugacaucag

SEQ ID NO: 20659 - RNA, 23 nt, Artificial Sequence
  Synthetic
aacacccuucugcuugacaucag

SEQ ID NO: 20660 - RNA, 24 nt, Artificial Sequence
  Synthetic
uaacacccuucugcuugacaucag

SEQ ID NO: 20661 - RNA, 21 nt, Artificial Sequence
  Synthetic
aauugaucuugaagacauacg

SEQ ID NO: 20662 - RNA, 23 nt, Artificial Sequence
  Synthetic
agaauugaucuugaagacauacg

SEQ ID NO: 20663 - RNA, 24 nt, Artificial Sequence
  Synthetic
uagaauugaucuugaagacauacg

SEQ ID NO: 20664 - RNA, 18 nt, Artificial Sequence
  Synthetic
acugugaauggugccagg

SEQ ID NO: 20665 - RNA, 19 nt, Artificial Sequence
  Synthetic
uacugugaauggugccagg

SEQ ID NO: 20666 - RNA, 20 nt, Artificial Sequence
  Synthetic
uuacugugaauggugccagg

SEQ ID NO: 20667 - RNA, 21 nt, Artificial Sequence
  Synthetic
uuuacugugaauggugccagg

SEQ ID NO: 20668 - RNA, 22 nt, Artificial Sequence
  Synthetic
cuuuacugugaauggugccagg

SEQ ID NO: 20669 - RNA, 23 nt, Artificial Sequence
  Synthetic
ucuuuacugugaauggugccagg

SEQ ID NO: 20670 - RNA, 24 nt, Artificial Sequence
  Synthetic
cucuuuacugugaauggugccagg

SEQ ID NO: 20671 - RNA, 18 nt, Artificial Sequence
  Synthetic
agaugauuauuaauaggg

SEQ ID NO: 20672 - RNA, 19 nt, Artificial Sequence
  Synthetic
uagaugauuauuaauaggg

SEQ ID NO: 20673 - RNA, 20 nt, Artificial Sequence
  Synthetic
cuagaugauuauuaauaggg

SEQ ID NO: 20674 - RNA, 21 nt, Artificial Sequence
  Synthetic
ccuagaugauuauuaauaggg

SEQ ID NO: 20675 - RNA, 23 nt, Artificial Sequence
  Synthetic
agccuagaugauuauuaauaggg

SEQ ID NO: 20676 - RNA, 24 nt, Artificial Sequence
  Synthetic
cagccuagaugauuauuaauaggg

SEQ ID NO: 20677 - RNA, 21 nt, Artificial Sequence
  Synthetic
cagguuaaguuguucuuaggg

SEQ ID NO: 20678 - RNA, 22 nt, Artificial Sequence
  Synthetic
ccagguuaaguuguucuuaggg

SEQ ID NO: 20679 - RNA, 24 nt, Artificial Sequence
  Synthetic
ugccagguuaaguuguucuuaggg

SEQ ID NO: 20680 - RNA, 18 nt, Artificial Sequence
  Synthetic
uaacaaaccuuuuauugg

SEQ ID NO: 20681 - RNA, 19 nt, Artificial Sequence
  Synthetic
uuaacaaaccuuuuauugg

SEQ ID NO: 20682 - RNA, 20 nt, Artificial Sequence
  Synthetic
uuuaacaaaccuuuuauugg

SEQ ID NO: 20683 - RNA, 18 nt, Artificial Sequence
  Synthetic
cuggauuggcuaccuugg

SEQ ID NO: 20684 - RNA, 19 nt, Artificial Sequence
  Synthetic
ccuggauuggcuaccuugg

SEQ ID NO: 20685 - RNA, 20 nt, Artificial Sequence
  Synthetic
accuggauuggcuaccuugg

SEQ ID NO: 20686 - RNA, 21 nt, Artificial Sequence
  Synthetic
uaccuggauuggcuaccuugg

SEQ ID NO: 20687 - RNA, 22 nt, Artificial Sequence
  Synthetic
uuaccuggauuggcuaccuugg

SEQ ID NO: 20688 - RNA, 24 nt, Artificial Sequence
  Synthetic
aguuaccuggauuggcuaccuugg

SEQ ID NO: 20689 - RNA, 19 nt, Artificial Sequence
  Synthetic
aggaaaugggguauaagug

SEQ ID NO: 20690 - RNA, 18 nt, Artificial Sequence
  Synthetic
uacauaaaaagagaggug

SEQ ID NO: 20691 - RNA, 19 nt, Artificial Sequence
  Synthetic
uuacauaaaaagagaggug

SEQ ID NO: 20692 - RNA, 21 nt, Artificial Sequence
  Synthetic
uguuacauaaaaagagaggug

SEQ ID NO: 20693 - RNA, 22 nt, Artificial Sequence
  Synthetic
uuguuacauaaaaagagaggug

SEQ ID NO: 20694 - RNA, 23 nt, Artificial Sequence
  Synthetic
auuguuacauaaaaagagaggug

SEQ ID NO: 20695 - RNA, 24 nt, Artificial Sequence
  Synthetic
uauuguuacauaaaaagagaggug

SEQ ID NO: 20696 - RNA, 18 nt, Artificial Sequence
  Synthetic
acaguuucaucuuacuug

SEQ ID NO: 20697 - RNA, 19 nt, Artificial Sequence
  Synthetic
aacaguuucaucuuacuug

SEQ ID NO: 20698 - RNA, 20 nt, Artificial Sequence
  Synthetic
uaacaguuucaucuuacuug

SEQ ID NO: 20699 - RNA, 21 nt, Artificial Sequence
  Synthetic
auaacaguuucaucuuacuug

SEQ ID NO: 20700 - RNA, 22 nt, Artificial Sequence
  Synthetic
uauaacaguuucaucuuacuug

SEQ ID NO: 20701 - RNA, 23 nt, Artificial Sequence
  Synthetic
uuauaacaguuucaucuuacuug

SEQ ID NO: 20702 - RNA, 24 nt, Artificial Sequence
  Synthetic
auuauaacaguuucaucuuacuug

SEQ ID NO: 20703 - RNA, 18 nt, Artificial Sequence
  Synthetic
uauuacaugggaaaaaau

SEQ ID NO: 20704 - RNA, 19 nt, Artificial Sequence
  Synthetic
uuauuacaugggaaaaaau

SEQ ID NO: 20705 - RNA, 20 nt, Artificial Sequence
  Synthetic
cuuauuacaugggaaaaaau

SEQ ID NO: 20706 - RNA, 21 nt, Artificial Sequence
  Synthetic
ucuuauuacaugggaaaaaau

SEQ ID NO: 20707 - RNA, 22 nt, Artificial Sequence
  Synthetic
uucuuauuacaugggaaaaaau

SEQ ID NO: 20708 - RNA, 23 nt, Artificial Sequence
  Synthetic
auucuuauuacaugggaaaaaau

SEQ ID NO: 20709 - RNA, 24 nt, Artificial Sequence
  Synthetic
aauucuuauuacaugggaaaaaau

SEQ ID NO: 20710 - RNA, 18 nt, Artificial Sequence
  Synthetic
auagcuuauucuauacau

SEQ ID NO: 20711 - RNA, 19 nt, Artificial Sequence
  Synthetic
aauagcuuauucuauacau

SEQ ID NO: 20712 - RNA, 20 nt, Artificial Sequence
  Synthetic
uaauagcuuauucuauacau

SEQ ID NO: 20713 - RNA, 21 nt, Artificial Sequence
  Synthetic
cuaauagcuuauucuauacau

SEQ ID NO: 20714 - RNA, 23 nt, Artificial Sequence
  Synthetic
agcuaauagcuuauucuauacau

SEQ ID NO: 20715 - RNA, 18 nt, Artificial Sequence
  Synthetic
augauguacauuuaauau

SEQ ID NO: 20716 - RNA, 19 nt, Artificial Sequence
  Synthetic
aaugauguacauuuaauau

SEQ ID NO: 20717 - RNA, 20 nt, Artificial Sequence
  Synthetic
uaaugauguacauuuaauau

SEQ ID NO: 20718 - RNA, 21 nt, Artificial Sequence
  Synthetic
auaaugauguacauuuaauau

SEQ ID NO: 20719 - RNA, 22 nt, Artificial Sequence
  Synthetic
aauaaugauguacauuuaauau

SEQ ID NO: 20720 - RNA, 24 nt, Artificial Sequence
  Synthetic
ugaauaaugauguacauuuaauau

SEQ ID NO: 20721 - RNA, 18 nt, Artificial Sequence
  Synthetic
agaucucugcaaacauau

SEQ ID NO: 20722 - RNA, 19 nt, Artificial Sequence
  Synthetic
aagaucucugcaaacauau

SEQ ID NO: 20723 - RNA, 20 nt, Artificial Sequence
  Synthetic
uaagaucucugcaaacauau

SEQ ID NO: 20724 - RNA, 21 nt, Artificial Sequence
  Synthetic
auaagaucucugcaaacauau

SEQ ID NO: 20725 - RNA, 22 nt, Artificial Sequence
  Synthetic
cauaagaucucugcaaacauau

SEQ ID NO: 20726 - RNA, 23 nt, Artificial Sequence
  Synthetic
acauaagaucucugcaaacauau

SEQ ID NO: 20727 - RNA, 24 nt, Artificial Sequence
  Synthetic
uacauaagaucucugcaaacauau

SEQ ID NO: 20728 - RNA, 18 nt, Artificial Sequence
  Synthetic
aauggaaacacuauauau

SEQ ID NO: 20729 - RNA, 19 nt, Artificial Sequence
  Synthetic
uaauggaaacacuauauau

SEQ ID NO: 20730 - RNA, 21 nt, Artificial Sequence
  Synthetic
uguaauggaaacacuauauau

SEQ ID NO: 20731 - RNA, 22 nt, Artificial Sequence
  Synthetic
auguaauggaaacacuauauau

SEQ ID NO: 20732 - RNA, 23 nt, Artificial Sequence
  Synthetic
aauguaauggaaacacuauauau

SEQ ID NO: 20733 - RNA, 24 nt, Artificial Sequence
  Synthetic
caauguaauggaaacacuauauau

SEQ ID NO: 20734 - RNA, 18 nt, Artificial Sequence
  Synthetic
uccaacuaacaucucuau

SEQ ID NO: 20735 - RNA, 19 nt, Artificial Sequence
  Synthetic
auccaacuaacaucucuau

SEQ ID NO: 20736 - RNA, 20 nt, Artificial Sequence
  Synthetic
cauccaacuaacaucucuau

SEQ ID NO: 20737 - RNA, 21 nt, Artificial Sequence
  Synthetic
acauccaacuaacaucucuau

SEQ ID NO: 20738 - RNA, 22 nt, Artificial Sequence
  Synthetic
uacauccaacuaacaucucuau

SEQ ID NO: 20739 - RNA, 24 nt, Artificial Sequence
  Synthetic
uguacauccaacuaacaucucuau

SEQ ID NO: 20740 - RNA, 18 nt, Artificial Sequence
  Synthetic
uccuuaaccucuaauacu

SEQ ID NO: 20741 - RNA, 19 nt, Artificial Sequence
  Synthetic
cuccuuaaccucuaauacu

SEQ ID NO: 20742 - RNA, 20 nt, Artificial Sequence
  Synthetic
ccuccuuaaccucuaauacu

SEQ ID NO: 20743 - RNA, 21 nt, Artificial Sequence
  Synthetic
accuccuuaaccucuaauacu

SEQ ID NO: 20744 - RNA, 22 nt, Artificial Sequence
  Synthetic
caccuccuuaaccucuaauacu

SEQ ID NO: 20745 - RNA, 23 nt, Artificial Sequence
  Synthetic
ccaccuccuuaaccucuaauacu

SEQ ID NO: 20746 - RNA, 24 nt, Artificial Sequence
  Synthetic
cccaccuccuuaaccucuaauacu

SEQ ID NO: 20747 - RNA, 22 nt, Artificial Sequence
  Synthetic
uggaaaauguuaaauuuucccu

SEQ ID NO: 20748 - RNA, 23 nt, Artificial Sequence
  Synthetic
cuggaaaauguuaaauuuucccu

SEQ ID NO: 20749 - RNA, 24 nt, Artificial Sequence
  Synthetic
ucuggaaaauguuaaauuuucccu

SEQ ID NO: 20750 - RNA, 21 nt, Artificial Sequence
  Synthetic
uaggcacuuguugacaguccu

SEQ ID NO: 20751 - RNA, 22 nt, Artificial Sequence
  Synthetic
cuaggcacuuguugacaguccu

SEQ ID NO: 20752 - RNA, 24 nt, Artificial Sequence
  Synthetic
ugcuaggcacuuguugacaguccu

SEQ ID NO: 20753 - RNA, 18 nt, Artificial Sequence
  Synthetic
uacucaguccagaaagcu

SEQ ID NO: 20754 - RNA, 19 nt, Artificial Sequence
  Synthetic
uuacucaguccagaaagcu

SEQ ID NO: 20755 - RNA, 19 nt, Artificial Sequence
  Synthetic
ugugcaaguccucugugcu

SEQ ID NO: 20756 - RNA, 20 nt, Artificial Sequence
  Synthetic
augugcaaguccucugugcu

SEQ ID NO: 20757 - RNA, 21 nt, Artificial Sequence
  Synthetic
uaugugcaaguccucugugcu

SEQ ID NO: 20758 - RNA, 22 nt, Artificial Sequence
  Synthetic
auaugugcaaguccucugugcu

SEQ ID NO: 20759 - RNA, 23 nt, Artificial Sequence
  Synthetic
cauaugugcaaguccucugugcu

SEQ ID NO: 20760 - RNA, 24 nt, Artificial Sequence
  Synthetic
acauaugugcaaguccucugugcu

SEQ ID NO: 20761 - RNA, 18 nt, Artificial Sequence
  Synthetic
uuaauugccaguaagucu

SEQ ID NO: 20762 - RNA, 19 nt, Artificial Sequence
  Synthetic
uuuaauugccaguaagucu

SEQ ID NO: 20763 - RNA, 19 nt, Artificial Sequence
  Synthetic
ugccagguuaaguuguucu

SEQ ID NO: 20764 - RNA, 20 nt, Artificial Sequence
  Synthetic
augccagguuaaguuguucu

SEQ ID NO: 20765 - RNA, 18 nt, Artificial Sequence
  Synthetic
agaguguauggcaugagu

SEQ ID NO: 20766 - RNA, 19 nt, Artificial Sequence
  Synthetic
uagaguguauggcaugagu

SEQ ID NO: 20767 - RNA, 20 nt, Artificial Sequence
  Synthetic
uuagaguguauggcaugagu

SEQ ID NO: 20768 - RNA, 21 nt, Artificial Sequence
  Synthetic
uuuagaguguauggcaugagu

SEQ ID NO: 20769 - RNA, 22 nt, Artificial Sequence
  Synthetic
auuuagaguguauggcaugagu

SEQ ID NO: 20770 - RNA, 23 nt, Artificial Sequence
  Synthetic
uauuuagaguguauggcaugagu

SEQ ID NO: 20771 - RNA, 24 nt, Artificial Sequence
  Synthetic
cuauuuagaguguauggcaugagu

SEQ ID NO: 20772 - RNA, 18 nt, Artificial Sequence
  Synthetic
agggucucucuaaggugu

SEQ ID NO: 20773 - RNA, 20 nt, Artificial Sequence
  Synthetic
ugagggucucucuaaggugu

SEQ ID NO: 20774 - RNA, 21 nt, Artificial Sequence
  Synthetic
uggggaaaucagcacucuauu

SEQ ID NO: 20775 - RNA, 23 nt, Artificial Sequence
  Synthetic
uguggggaaaucagcacucuauu

SEQ ID NO: 20776 - RNA, 24 nt, Artificial Sequence
  Synthetic
cuguggggaaaucagcacucuauu

SEQ ID NO: 20777 - RNA, 19 nt, Artificial Sequence
  Synthetic
uguaacucuuuauucacuu

SEQ ID NO: 20778 - RNA, 20 nt, Artificial Sequence
  Synthetic
uuguaacucuuuauucacuu

SEQ ID NO: 20779 - RNA, 21 nt, Artificial Sequence
  Synthetic
uuuguaacucuuuauucacuu

SEQ ID NO: 20780 - RNA, 22 nt, Artificial Sequence
  Synthetic
uuuuguaacucuuuauucacuu

SEQ ID NO: 20781 - RNA, 23 nt, Artificial Sequence
  Synthetic
auuuuguaacucuuuauucacuu

SEQ ID NO: 20782 - RNA, 24 nt, Artificial Sequence
  Synthetic
cauuuuguaacucuuuauucacuu

SEQ ID NO: 20783 - RNA, 18 nt, Artificial Sequence
  Synthetic
uaucaacccucuuuccuu

SEQ ID NO: 20784 - RNA, 19 nt, Artificial Sequence
  Synthetic
uuaucaacccucuuuccuu

SEQ ID NO: 20785 - RNA, 20 nt, Artificial Sequence
  Synthetic
cuuaucaacccucuuuccuu

SEQ ID NO: 20786 - RNA, 21 nt, Artificial Sequence
  Synthetic
ucuuaucaacccucuuuccuu

SEQ ID NO: 20787 - RNA, 22 nt, Artificial Sequence
  Synthetic
uucuuaucaacccucuuuccuu

SEQ ID NO: 20788 - RNA, 23 nt, Artificial Sequence
  Synthetic
cuucuuaucaacccucuuuccuu

SEQ ID NO: 20789 - RNA, 24 nt, Artificial Sequence
  Synthetic
ucuucuuaucaacccucuuuccuu

SEQ ID NO: 20790 - RNA, 18 nt, Artificial Sequence
  Synthetic
uuuaucaacaugaagguu

SEQ ID NO: 20791 - RNA, 19 nt, Artificial Sequence
  Synthetic
cuuuaucaacaugaagguu

SEQ ID NO: 20792 - RNA, 19 nt, Artificial Sequence
  Synthetic
ugcuuucaggagccaaaaa

SEQ ID NO: 20793 - RNA, 20 nt, Artificial Sequence
  Synthetic
cugcuuucaggagccaaaaa

SEQ ID NO: 20794 - RNA, 21 nt, Artificial Sequence
  Synthetic
acugcuuucaggagccaaaaa

SEQ ID NO: 20795 - RNA, 22 nt, Artificial Sequence
  Synthetic
cacugcuuucaggagccaaaaa

SEQ ID NO: 20796 - RNA, 23 nt, Artificial Sequence
  Synthetic
acacugcuuucaggagccaaaaa

SEQ ID NO: 20797 - RNA, 24 nt, Artificial Sequence
  Synthetic
aacacugcuuucaggagccaaaaa

SEQ ID NO: 20798 - RNA, 18 nt, Artificial Sequence
  Synthetic
uuaaacacuucugagaaa

SEQ ID NO: 20799 - RNA, 19 nt, Artificial Sequence
  Synthetic
uuuaaacacuucugagaaa

SEQ ID NO: 20800 - RNA, 18 nt, Artificial Sequence
  Synthetic
auaagauucuaaaggaaa

SEQ ID NO: 20801 - RNA, 21 nt, Artificial Sequence
  Synthetic
uggauaagauucuaaaggaaa

SEQ ID NO: 20802 - RNA, 22 nt, Artificial Sequence
  Synthetic
cuggauaagauucuaaaggaaa

SEQ ID NO: 20803 - RNA, 18 nt, Artificial Sequence
  Synthetic
caugccauacacucuaaa

SEQ ID NO: 20804 - RNA, 19 nt, Artificial Sequence
  Synthetic
ucaugccauacacucuaaa

SEQ ID NO: 20805 - RNA, 20 nt, Artificial Sequence
  Synthetic
cucaugccauacacucuaaa

SEQ ID NO: 20806 - RNA, 21 nt, Artificial Sequence
  Synthetic
acucaugccauacacucuaaa

SEQ ID NO: 20807 - RNA, 22 nt, Artificial Sequence
  Synthetic
uacucaugccauacacucuaaa

SEQ ID NO: 20808 - RNA, 24 nt, Artificial Sequence
  Synthetic
cguacucaugccauacacucuaaa

SEQ ID NO: 20809 - RNA, 18 nt, Artificial Sequence
  Synthetic
agguuuaauuuuguacaa

SEQ ID NO: 20810 - RNA, 19 nt, Artificial Sequence
  Synthetic
uagguuuaauuuuguacaa

SEQ ID NO: 20811 - RNA, 21 nt, Artificial Sequence
  Synthetic
ucuagguuuaauuuuguacaa

SEQ ID NO: 20812 - RNA, 22 nt, Artificial Sequence
  Synthetic
uucuagguuuaauuuuguacaa

SEQ ID NO: 20813 - RNA, 23 nt, Artificial Sequence
  Synthetic
cuucuagguuuaauuuuguacaa

SEQ ID NO: 20814 - RNA, 24 nt, Artificial Sequence
  Synthetic
acuucuagguuuaauuuuguacaa

SEQ ID NO: 20815 - RNA, 18 nt, Artificial Sequence
  Synthetic
cuuugaaggaagauccaa

SEQ ID NO: 20816 - RNA, 20 nt, Artificial Sequence
  Synthetic
ugcuuugaaggaagauccaa

SEQ ID NO: 20817 - RNA, 18 nt, Artificial Sequence
  Synthetic
uaaucaucuaggcugcaa

SEQ ID NO: 20818 - RNA, 19 nt, Artificial Sequence
  Synthetic
auaaucaucuaggcugcaa

SEQ ID NO: 20819 - RNA, 20 nt, Artificial Sequence
  Synthetic
aauaaucaucuaggcugcaa

SEQ ID NO: 20820 - RNA, 21 nt, Artificial Sequence
  Synthetic
uaauaaucaucuaggcugcaa

SEQ ID NO: 20821 - RNA, 22 nt, Artificial Sequence
  Synthetic
uuaauaaucaucuaggcugcaa

SEQ ID NO: 20822 - RNA, 23 nt, Artificial Sequence
  Synthetic
auuaauaaucaucuaggcugcaa

SEQ ID NO: 20823 - RNA, 24 nt, Artificial Sequence
  Synthetic
uauuaauaaucaucuaggcugcaa

SEQ ID NO: 20824 - RNA, 22 nt, Artificial Sequence
  Synthetic
aggagaaccauauuuugaagaa

SEQ ID NO: 20825 - RNA, 24 nt, Artificial Sequence
  Synthetic
ugaggagaaccauauuuugaagaa

SEQ ID NO: 20826 - RNA, 19 nt, Artificial Sequence
  Synthetic
aggguugauaagaagagaa

SEQ ID NO: 20827 - RNA, 21 nt, Artificial Sequence
  Synthetic
agaggguugauaagaagagaa

SEQ ID NO: 20828 - RNA, 22 nt, Artificial Sequence
  Synthetic
aagaggguugauaagaagagaa

SEQ ID NO: 20829 - RNA, 23 nt, Artificial Sequence
  Synthetic
aaagaggguugauaagaagagaa

SEQ ID NO: 20830 - RNA, 18 nt, Artificial Sequence
  Synthetic
ugcucucugaccacauaa

SEQ ID NO: 20831 - RNA, 19 nt, Artificial Sequence
  Synthetic
uugcucucugaccacauaa

SEQ ID NO: 20832 - RNA, 20 nt, Artificial Sequence
  Synthetic
cuugcucucugaccacauaa

SEQ ID NO: 20833 - RNA, 21 nt, Artificial Sequence
  Synthetic
acuugcucucugaccacauaa

SEQ ID NO: 20834 - RNA, 22 nt, Artificial Sequence
  Synthetic
uacuugcucucugaccacauaa

SEQ ID NO: 20835 - RNA, 24 nt, Artificial Sequence
  Synthetic
uguacuugcucucugaccacauaa

SEQ ID NO: 20836 - RNA, 18 nt, Artificial Sequence
  Synthetic
uauaugauauacucuuaa

SEQ ID NO: 20837 - RNA, 20 nt, Artificial Sequence
  Synthetic
uguauaugauauacucuuaa

SEQ ID NO: 20838 - RNA, 21 nt, Artificial Sequence
  Synthetic
auguauaugauauacucuuaa

SEQ ID NO: 20839 - RNA, 24 nt, Artificial Sequence
  Synthetic
cggauguauaugauauacucuuaa

SEQ ID NO: 20840 - RNA, 21 nt, Artificial Sequence
  Synthetic
aacucauuaggaaaauguaca

SEQ ID NO: 20841 - RNA, 22 nt, Artificial Sequence
  Synthetic
caacucauuaggaaaauguaca

SEQ ID NO: 20842 - RNA, 23 nt, Artificial Sequence
  Synthetic
ccaacucauuaggaaaauguaca

SEQ ID NO: 20843 - RNA, 24 nt, Artificial Sequence
  Synthetic
accaacucauuaggaaaauguaca

SEQ ID NO: 20844 - RNA, 18 nt, Artificial Sequence
  Synthetic
augaaguuaaaaacauca

SEQ ID NO: 20845 - RNA, 19 nt, Artificial Sequence
  Synthetic
uaugaaguuaaaaacauca

SEQ ID NO: 20846 - RNA, 20 nt, Artificial Sequence
  Synthetic
auaugaaguuaaaaacauca

SEQ ID NO: 20847 - RNA, 19 nt, Artificial Sequence
  Synthetic
aguauagaauuuugcauca

SEQ ID NO: 20848 - RNA, 20 nt, Artificial Sequence
  Synthetic
uaguauagaauuuugcauca

SEQ ID NO: 20849 - RNA, 19 nt, Artificial Sequence
  Synthetic
agguaguaauuguguuuca

SEQ ID NO: 20850 - RNA, 20 nt, Artificial Sequence
  Synthetic
aagguaguaauuguguuuca

SEQ ID NO: 20851 - RNA, 21 nt, Artificial Sequence
  Synthetic
aaagguaguaauuguguuuca

SEQ ID NO: 20852 - RNA, 22 nt, Artificial Sequence
  Synthetic
aaaagguaguaauuguguuuca

SEQ ID NO: 20853 - RNA, 24 nt, Artificial Sequence
  Synthetic
ugaaaagguaguaauuguguuuca

SEQ ID NO: 20854 - RNA, 18 nt, Artificial Sequence
  Synthetic
agagccuuuucuuuuuca

SEQ ID NO: 20855 - RNA, 19 nt, Artificial Sequence
  Synthetic
aagagccuuuucuuuuuca

SEQ ID NO: 20856 - RNA, 20 nt, Artificial Sequence
  Synthetic
aaagagccuuuucuuuuuca

SEQ ID NO: 20857 - RNA, 18 nt, Artificial Sequence
  Synthetic
ucuagcuaaaauauaaga

SEQ ID NO: 20858 - RNA, 19 nt, Artificial Sequence
  Synthetic
aucuagcuaaaauauaaga

SEQ ID NO: 20859 - RNA, 21 nt, Artificial Sequence
  Synthetic
cuugaccagaaugaaauuaga

SEQ ID NO: 20860 - RNA, 22 nt, Artificial Sequence
  Synthetic
acuugaccagaaugaaauuaga

SEQ ID NO: 20861 - RNA, 23 nt, Artificial Sequence
  Synthetic
aacuugaccagaaugaaauuaga

SEQ ID NO: 20862 - RNA, 24 nt, Artificial Sequence
  Synthetic
aaacuugaccagaaugaaauuaga

SEQ ID NO: 20863 - RNA, 18 nt, Artificial Sequence
  Synthetic
aggaaaauguacaaagga

SEQ ID NO: 20864 - RNA, 19 nt, Artificial Sequence
  Synthetic
uaggaaaauguacaaagga

SEQ ID NO: 20865 - RNA, 20 nt, Artificial Sequence
  Synthetic
uuaggaaaauguacaaagga

SEQ ID NO: 20866 - RNA, 19 nt, Artificial Sequence
  Synthetic
ugauuccaagcuuucugga

SEQ ID NO: 20867 - RNA, 20 nt, Artificial Sequence
  Synthetic
augauuccaagcuuucugga

SEQ ID NO: 20868 - RNA, 18 nt, Artificial Sequence
  Synthetic
uauacucuuaagugaaua

SEQ ID NO: 20869 - RNA, 19 nt, Artificial Sequence
  Synthetic
auauacucuuaagugaaua

SEQ ID NO: 20870 - RNA, 21 nt, Artificial Sequence
  Synthetic
ugauauacucuuaagugaaua

SEQ ID NO: 20871 - RNA, 22 nt, Artificial Sequence
  Synthetic
augauauacucuuaagugaaua

SEQ ID NO: 20872 - RNA, 23 nt, Artificial Sequence
  Synthetic
uaugauauacucuuaagugaaua

SEQ ID NO: 20873 - RNA, 24 nt, Artificial Sequence
  Synthetic
auaugauauacucuuaagugaaua

SEQ ID NO: 20874 - RNA, 18 nt, Artificial Sequence
  Synthetic
cuaaccuucauguugaua

SEQ ID NO: 20875 - RNA, 19 nt, Artificial Sequence
  Synthetic
ccuaaccuucauguugaua

SEQ ID NO: 20876 - RNA, 20 nt, Artificial Sequence
  Synthetic
cccuaaccuucauguugaua

SEQ ID NO: 20877 - RNA, 18 nt, Artificial Sequence
  Synthetic
uggauauucuaugauaua

SEQ ID NO: 20878 - RNA, 19 nt, Artificial Sequence
  Synthetic
auggauauucuaugauaua

SEQ ID NO: 20879 - RNA, 22 nt, Artificial Sequence
  Synthetic
uggauggauauucuaugauaua

SEQ ID NO: 20880 - RNA, 23 nt, Artificial Sequence
  Synthetic
auggauggauauucuaugauaua

SEQ ID NO: 20881 - RNA, 24 nt, Artificial Sequence
  Synthetic
uauggauggauauucuaugauaua

SEQ ID NO: 20882 - RNA, 18 nt, Artificial Sequence
  Synthetic
auacuuucuagaauuaua

SEQ ID NO: 20883 - RNA, 19 nt, Artificial Sequence
  Synthetic
aauacuuucuagaauuaua

SEQ ID NO: 20884 - RNA, 20 nt, Artificial Sequence
  Synthetic
aaauacuuucuagaauuaua

SEQ ID NO: 20885 - RNA, 18 nt, Artificial Sequence
  Synthetic
uuuugcuugcuuuuuaua

SEQ ID NO: 20886 - RNA, 19 nt, Artificial Sequence
  Synthetic
uuuuugcuugcuuuuuaua

SEQ ID NO: 20887 - RNA, 18 nt, Artificial Sequence
  Synthetic
ucugagaagacaaagcua

SEQ ID NO: 20888 - RNA, 20 nt, Artificial Sequence
  Synthetic
agucugagaagacaaagcua

SEQ ID NO: 20889 - RNA, 21 nt, Artificial Sequence
  Synthetic
aagucugagaagacaaagcua

SEQ ID NO: 20890 - RNA, 22 nt, Artificial Sequence
  Synthetic
aaagucugagaagacaaagcua

SEQ ID NO: 20891 - RNA, 23 nt, Artificial Sequence
  Synthetic
aaaagucugagaagacaaagcua

SEQ ID NO: 20892 - RNA, 24 nt, Artificial Sequence
  Synthetic
uaaaagucugagaagacaaagcua

SEQ ID NO: 20893 - RNA, 18 nt, Artificial Sequence
  Synthetic
agugaagcaauauuagua

SEQ ID NO: 20894 - RNA, 19 nt, Artificial Sequence
  Synthetic
uagugaagcaauauuagua

SEQ ID NO: 20895 - RNA, 20 nt, Artificial Sequence
  Synthetic
uuagugaagcaauauuagua

SEQ ID NO: 20896 - RNA, 21 nt, Artificial Sequence
  Synthetic
uuuagugaagcaauauuagua

SEQ ID NO: 20897 - RNA, 22 nt, Artificial Sequence
  Synthetic
uuuuagugaagcaauauuagua

SEQ ID NO: 20898 - RNA, 23 nt, Artificial Sequence
  Synthetic
auuuuagugaagcaauauuagua

SEQ ID NO: 20899 - RNA, 24 nt, Artificial Sequence
  Synthetic
uauuuuagugaagcaauauuagua

SEQ ID NO: 20900 - RNA, 18 nt, Artificial Sequence
  Synthetic
uaaucggcgguggaggua

SEQ ID NO: 20901 - RNA, 21 nt, Artificial Sequence
  Synthetic
aaguaaucggcgguggaggua

SEQ ID NO: 20902 - RNA, 23 nt, Artificial Sequence
  Synthetic
agaaguaaucggcgguggaggua

SEQ ID NO: 20903 - RNA, 18 nt, Artificial Sequence
  Synthetic
cauugccucacuauggua

SEQ ID NO: 20904 - RNA, 19 nt, Artificial Sequence
  Synthetic
ucauugccucacuauggua

SEQ ID NO: 20905 - RNA, 20 nt, Artificial Sequence
  Synthetic
aucauugccucacuauggua

SEQ ID NO: 20906 - RNA, 22 nt, Artificial Sequence
  Synthetic
ugaucauugccucacuauggua

SEQ ID NO: 20907 - RNA, 23 nt, Artificial Sequence
  Synthetic
uugaucauugccucacuauggua

SEQ ID NO: 20908 - RNA, 24 nt, Artificial Sequence
  Synthetic
auugaucauugccucacuauggua

SEQ ID NO: 20909 - RNA, 18 nt, Artificial Sequence
  Synthetic
aacugggacucauaugua

SEQ ID NO: 20910 - RNA, 19 nt, Artificial Sequence
  Synthetic
uaacugggacucauaugua

SEQ ID NO: 20911 - RNA, 20 nt, Artificial Sequence
  Synthetic
auaacugggacucauaugua

SEQ ID NO: 20912 - RNA, 21 nt, Artificial Sequence
  Synthetic
aauaacugggacucauaugua

SEQ ID NO: 20913 - RNA, 22 nt, Artificial Sequence
  Synthetic
uaauaacugggacucauaugua

SEQ ID NO: 20914 - RNA, 24 nt, Artificial Sequence
  Synthetic
uguaauaacugggacucauaugua

SEQ ID NO: 20915 - RNA, 20 nt, Artificial Sequence
  Synthetic
aggaagauccaauaggauua

SEQ ID NO: 20916 - RNA, 21 nt, Artificial Sequence
  Synthetic
aaggaagauccaauaggauua

SEQ ID NO: 20917 - RNA, 23 nt, Artificial Sequence
  Synthetic
ugaaggaagauccaauaggauua

SEQ ID NO: 20918 - RNA, 24 nt, Artificial Sequence
  Synthetic
uugaaggaagauccaauaggauua

SEQ ID NO: 20919 - RNA, 19 nt, Artificial Sequence
  Synthetic
ugcaggaggugagggauua

SEQ ID NO: 20920 - RNA, 21 nt, Artificial Sequence
  Synthetic
cagccaauaaaagguuuguua

SEQ ID NO: 20921 - RNA, 22 nt, Artificial Sequence
  Synthetic
ucagccaauaaaagguuuguua

SEQ ID NO: 20922 - RNA, 23 nt, Artificial Sequence
  Synthetic
uucagccaauaaaagguuuguua

SEQ ID NO: 20923 - RNA, 24 nt, Artificial Sequence
  Synthetic
auucagccaauaaaagguuuguua

SEQ ID NO: 20924 - RNA, 19 nt, Artificial Sequence
  Synthetic
aguuagcaauggucuaaac

SEQ ID NO: 20925 - RNA, 20 nt, Artificial Sequence
  Synthetic
aaguuagcaauggucuaaac

SEQ ID NO: 20926 - RNA, 18 nt, Artificial Sequence
  Synthetic
auucuguuuaaauagcac

SEQ ID NO: 20927 - RNA, 21 nt, Artificial Sequence
  Synthetic
cugauucuguuuaaauagcac

SEQ ID NO: 20928 - RNA, 22 nt, Artificial Sequence
  Synthetic
ccugauucuguuuaaauagcac

SEQ ID NO: 20929 - RNA, 23 nt, Artificial Sequence
  Synthetic
cccugauucuguuuaaauagcac

SEQ ID NO: 20930 - RNA, 24 nt, Artificial Sequence
  Synthetic
ccccugauucuguuuaaauagcac

SEQ ID NO: 20931 - RNA, 19 nt, Artificial Sequence
  Synthetic
agagaaggucaaacuugac

SEQ ID NO: 20932 - RNA, 20 nt, Artificial Sequence
  Synthetic
uagagaaggucaaacuugac

SEQ ID NO: 20933 - RNA, 22 nt, Artificial Sequence
  Synthetic
aguagagaaggucaaacuugac

SEQ ID NO: 20934 - RNA, 23 nt, Artificial Sequence
  Synthetic
uaguagagaaggucaaacuugac

SEQ ID NO: 20935 - RNA, 24 nt, Artificial Sequence
  Synthetic
auaguagagaaggucaaacuugac

SEQ ID NO: 20936 - RNA, 18 nt, Artificial Sequence
  Synthetic
cucuauauaaagugaucc

SEQ ID NO: 20937 - RNA, 19 nt, Artificial Sequence
  Synthetic
ucucuauauaaagugaucc

SEQ ID NO: 20938 - RNA, 20 nt, Artificial Sequence
  Synthetic
cucucuauauaaagugaucc

SEQ ID NO: 20939 - RNA, 21 nt, Artificial Sequence
  Synthetic
ucucucuauauaaagugaucc

SEQ ID NO: 20940 - RNA, 22 nt, Artificial Sequence
  Synthetic
uucucucuauauaaagugaucc

SEQ ID NO: 20941 - RNA, 23 nt, Artificial Sequence
  Synthetic
uuucucucuauauaaagugaucc

SEQ ID NO: 20942 - RNA, 24 nt, Artificial Sequence
  Synthetic
auuucucucuauauaaagugaucc

SEQ ID NO: 20943 - RNA, 18 nt, Artificial Sequence
  Synthetic
auucuuuugauauacucc

SEQ ID NO: 20944 - RNA, 19 nt, Artificial Sequence
  Synthetic
uauucuuuugauauacucc

SEQ ID NO: 20945 - RNA, 21 nt, Artificial Sequence
  Synthetic
cuuauucuuuugauauacucc

SEQ ID NO: 20946 - RNA, 22 nt, Artificial Sequence
  Synthetic
ccuuauucuuuugauauacucc

SEQ ID NO: 20947 - RNA, 24 nt, Artificial Sequence
  Synthetic
ugccuuauucuuuugauauacucc

SEQ ID NO: 20948 - RNA, 18 nt, Artificial Sequence
  Synthetic
ugcgcuuaugaaacuucc

SEQ ID NO: 20949 - RNA, 19 nt, Artificial Sequence
  Synthetic
uugcgcuuaugaaacuucc

SEQ ID NO: 20950 - RNA, 20 nt, Artificial Sequence
  Synthetic
cuugcgcuuaugaaacuucc

SEQ ID NO: 20951 - RNA, 21 nt, Artificial Sequence
  Synthetic
ucuugcgcuuaugaaacuucc

SEQ ID NO: 20952 - RNA, 23 nt, Artificial Sequence
  Synthetic
ugucuugcgcuuaugaaacuucc

SEQ ID NO: 20953 - RNA, 24 nt, Artificial Sequence
  Synthetic
augucuugcgcuuaugaaacuucc

SEQ ID NO: 20954 - RNA, 18 nt, Artificial Sequence
  Synthetic
aaaccaaacaagcuuucc

SEQ ID NO: 20955 - RNA, 19 nt, Artificial Sequence
  Synthetic
aaaaccaaacaagcuuucc

SEQ ID NO: 20956 - RNA, 20 nt, Artificial Sequence
  Synthetic
uaaaaccaaacaagcuuucc

SEQ ID NO: 20957 - RNA, 18 nt, Artificial Sequence
  Synthetic
cuuuuaaaacaaaauagc

SEQ ID NO: 20958 - RNA, 19 nt, Artificial Sequence
  Synthetic
aggaagacagcuggcuauc

SEQ ID NO: 20959 - RNA, 20 nt, Artificial Sequence
  Synthetic
caggaagacagcuggcuauc

SEQ ID NO: 20960 - RNA, 22 nt, Artificial Sequence
  Synthetic
agcaggaagacagcuggcuauc

SEQ ID NO: 20961 - RNA, 23 nt, Artificial Sequence
  Synthetic
cagcaggaagacagcuggcuauc

SEQ ID NO: 20962 - RNA, 24 nt, Artificial Sequence
  Synthetic
acagcaggaagacagcuggcuauc

SEQ ID NO: 20963 - RNA, 19 nt, Artificial Sequence
  Synthetic
agcuggcuauccaggauuc

SEQ ID NO: 20964 - RNA, 21 nt, Artificial Sequence
  Synthetic
acagcuggcuauccaggauuc

SEQ ID NO: 20965 - RNA, 23 nt, Artificial Sequence
  Synthetic
agacagcuggcuauccaggauuc

SEQ ID NO: 20966 - RNA, 24 nt, Artificial Sequence
  Synthetic
aagacagcuggcuauccaggauuc

SEQ ID NO: 20967 - RNA, 18 nt, Artificial Sequence
  Synthetic
uucuguaauuuuugcuuc

SEQ ID NO: 20968 - RNA, 19 nt, Artificial Sequence
  Synthetic
agacuuuguagugaucuuc

SEQ ID NO: 20969 - RNA, 20 nt, Artificial Sequence
  Synthetic
aagacuuuguagugaucuuc

SEQ ID NO: 20970 - RNA, 22 nt, Artificial Sequence
  Synthetic
agaagacuuuguagugaucuuc

SEQ ID NO: 20971 - RNA, 19 nt, Artificial Sequence
  Synthetic
agcuuuucaaaauacuuuc

SEQ ID NO: 20972 - RNA, 20 nt, Artificial Sequence
  Synthetic
aagcuuuucaaaauacuuuc

SEQ ID NO: 20973 - RNA, 22 nt, Artificial Sequence
  Synthetic
ugaagcuuuucaaaauacuuuc

SEQ ID NO: 20974 - RNA, 23 nt, Artificial Sequence
  Synthetic
uugaagcuuuucaaaauacuuuc

SEQ ID NO: 20975 - RNA, 24 nt, Artificial Sequence
  Synthetic
cuugaagcuuuucaaaauacuuuc

SEQ ID NO: 20976 - RNA, 18 nt, Artificial Sequence
  Synthetic
aacaguacaagaaaaaag

SEQ ID NO: 20977 - RNA, 19 nt, Artificial Sequence
  Synthetic
uaacaguacaagaaaaaag

SEQ ID NO: 20978 - RNA, 18 nt, Artificial Sequence
  Synthetic
ugccauuaacagauaaag

SEQ ID NO: 20979 - RNA, 19 nt, Artificial Sequence
  Synthetic
uugccauuaacagauaaag

SEQ ID NO: 20980 - RNA, 20 nt, Artificial Sequence
  Synthetic
uuugccauuaacagauaaag

SEQ ID NO: 20981 - RNA, 18 nt, Artificial Sequence
  Synthetic
auaugagaaaagucacag

SEQ ID NO: 20982 - RNA, 19 nt, Artificial Sequence
  Synthetic
cauaugagaaaagucacag

SEQ ID NO: 20983 - RNA, 22 nt, Artificial Sequence
  Synthetic
uggcauaugagaaaagucacag

SEQ ID NO: 20984 - RNA, 23 nt, Artificial Sequence
  Synthetic
auggcauaugagaaaagucacag

SEQ ID NO: 20985 - RNA, 24 nt, Artificial Sequence
  Synthetic
aauggcauaugagaaaagucacag

SEQ ID NO: 20986 - RNA, 18 nt, Artificial Sequence
  Synthetic
ccaacugaugucaagcag

SEQ ID NO: 20987 - RNA, 19 nt, Artificial Sequence
  Synthetic
cccaacugaugucaagcag

SEQ ID NO: 20988 - RNA, 20 nt, Artificial Sequence
  Synthetic
acccaacugaugucaagcag

SEQ ID NO: 20989 - RNA, 21 nt, Artificial Sequence
  Synthetic
aacccaacugaugucaagcag

SEQ ID NO: 20990 - RNA, 24 nt, Artificial Sequence
  Synthetic
cggaacccaacugaugucaagcag

SEQ ID NO: 20991 - RNA, 19 nt, Artificial Sequence
  Synthetic
aguauuagagguuaaggag

SEQ ID NO: 20992 - RNA, 20 nt, Artificial Sequence
  Synthetic
aaguauuagagguuaaggag

SEQ ID NO: 20993 - RNA, 21 nt, Artificial Sequence
  Synthetic
uaaguauuagagguuaaggag

SEQ ID NO: 20994 - RNA, 22 nt, Artificial Sequence
  Synthetic
cuaaguauuagagguuaaggag

SEQ ID NO: 20995 - RNA, 23 nt, Artificial Sequence
  Synthetic
ucuaaguauuagagguuaaggag

SEQ ID NO: 20996 - RNA, 24 nt, Artificial Sequence
  Synthetic
uucuaaguauuagagguuaaggag

SEQ ID NO: 20997 - RNA, 19 nt, Artificial Sequence
  Synthetic
agucuuuuccucuuaauag

SEQ ID NO: 20998 - RNA, 20 nt, Artificial Sequence
  Synthetic
aagucuuuuccucuuaauag

SEQ ID NO: 20999 - RNA, 22 nt, Artificial Sequence
  Synthetic
ugaagucuuuuccucuuaauag

SEQ ID NO: 21000 - RNA, 23 nt, Artificial Sequence
  Synthetic
cugaagucuuuuccucuuaauag

SEQ ID NO: 21001 - RNA, 24 nt, Artificial Sequence
  Synthetic
ccugaagucuuuuccucuuaauag

SEQ ID NO: 21002 - RNA, 19 nt, Artificial Sequence
  Synthetic
ugaaaagcagcuaugaagg

SEQ ID NO: 21003 - RNA, 20 nt, Artificial Sequence
  Synthetic
augaaaagcagcuaugaagg

SEQ ID NO: 21004 - RNA, 21 nt, Artificial Sequence
  Synthetic
uaugaaaagcagcuaugaagg

SEQ ID NO: 21005 - RNA, 22 nt, Artificial Sequence
  Synthetic
uuaugaaaagcagcuaugaagg

SEQ ID NO: 21006 - RNA, 23 nt, Artificial Sequence
  Synthetic
cuuaugaaaagcagcuaugaagg

SEQ ID NO: 21007 - RNA, 18 nt, Artificial Sequence
  Synthetic
uuucaacuuauacacagg

SEQ ID NO: 21008 - RNA, 19 nt, Artificial Sequence
  Synthetic
auuucaacuuauacacagg

SEQ ID NO: 21009 - RNA, 21 nt, Artificial Sequence
  Synthetic
ucauuucaacuuauacacagg

SEQ ID NO: 21010 - RNA, 22 nt, Artificial Sequence
  Synthetic
aucauuucaacuuauacacagg

SEQ ID NO: 21011 - RNA, 23 nt, Artificial Sequence
  Synthetic
uaucauuucaacuuauacacagg

SEQ ID NO: 21012 - RNA, 24 nt, Artificial Sequence
  Synthetic
auaucauuucaacuuauacacagg

SEQ ID NO: 21013 - RNA, 19 nt, Artificial Sequence
  Synthetic
uggcauagaguaagacagg

SEQ ID NO: 21014 - RNA, 20 nt, Artificial Sequence
  Synthetic
cuggcauagaguaagacagg

SEQ ID NO: 21015 - RNA, 23 nt, Artificial Sequence
  Synthetic
aggcuggcauagaguaagacagg

SEQ ID NO: 21016 - RNA, 18 nt, Artificial Sequence
  Synthetic
aauaaauuuggugucagg

SEQ ID NO: 21017 - RNA, 19 nt, Artificial Sequence
  Synthetic
caauaaauuuggugucagg

SEQ ID NO: 21018 - RNA, 20 nt, Artificial Sequence
  Synthetic
ucaauaaauuuggugucagg

SEQ ID NO: 21019 - RNA, 21 nt, Artificial Sequence
  Synthetic
cucaauaaauuuggugucagg

SEQ ID NO: 21020 - RNA, 22 nt, Artificial Sequence
  Synthetic
acucaauaaauuuggugucagg

SEQ ID NO: 21021 - RNA, 23 nt, Artificial Sequence
  Synthetic
cacucaauaaauuuggugucagg

SEQ ID NO: 21022 - RNA, 24 nt, Artificial Sequence
  Synthetic
ccacucaauaaauuuggugucagg

SEQ ID NO: 21023 - RNA, 19 nt, Artificial Sequence
  Synthetic
ugguagugugaagaugggg

SEQ ID NO: 21024 - RNA, 20 nt, Artificial Sequence
  Synthetic
cugguagugugaagaugggg

SEQ ID NO: 21025 - RNA, 19 nt, Artificial Sequence
  Synthetic
agggaaugcagacucuggg

SEQ ID NO: 21026 - RNA, 20 nt, Artificial Sequence
  Synthetic
uagggaaugcagacucuggg

SEQ ID NO: 21027 - RNA, 21 nt, Artificial Sequence
  Synthetic
uuagggaaugcagacucuggg

SEQ ID NO: 21028 - RNA, 22 nt, Artificial Sequence
  Synthetic
auuagggaaugcagacucuggg

SEQ ID NO: 21029 - RNA, 19 nt, Artificial Sequence
  Synthetic
ugggggagccccauaaaug

SEQ ID NO: 21030 - RNA, 18 nt, Artificial Sequence
  Synthetic
uuuuuauguaacaauaug

SEQ ID NO: 21031 - RNA, 19 nt, Artificial Sequence
  Synthetic
cuuuuuauguaacaauaug

SEQ ID NO: 21032 - RNA, 20 nt, Artificial Sequence
  Synthetic
ucuuuuuauguaacaauaug

SEQ ID NO: 21033 - RNA, 21 nt, Artificial Sequence
  Synthetic
cucuuuuuauguaacaauaug

SEQ ID NO: 21034 - RNA, 22 nt, Artificial Sequence
  Synthetic
ucucuuuuuauguaacaauaug

SEQ ID NO: 21035 - RNA, 23 nt, Artificial Sequence
  Synthetic
cucucuuuuuauguaacaauaug

SEQ ID NO: 21036 - RNA, 24 nt, Artificial Sequence
  Synthetic
ccucucuuuuuauguaacaauaug

SEQ ID NO: 21037 - RNA, 18 nt, Artificial Sequence
  Synthetic
ugagauuagaggccacug

SEQ ID NO: 21038 - RNA, 19 nt, Artificial Sequence
  Synthetic
ugcacauauguucagacug

SEQ ID NO: 21039 - RNA, 20 nt, Artificial Sequence
  Synthetic
uugcacauauguucagacug

SEQ ID NO: 21040 - RNA, 21 nt, Artificial Sequence
  Synthetic
cuugcacauauguucagacug

SEQ ID NO: 21041 - RNA, 22 nt, Artificial Sequence
  Synthetic
acuugcacauauguucagacug

SEQ ID NO: 21042 - RNA, 18 nt, Artificial Sequence
  Synthetic
uguuaaagaaugacugug

SEQ ID NO: 21043 - RNA, 19 nt, Artificial Sequence
  Synthetic
uuguuaaagaaugacugug

SEQ ID NO: 21044 - RNA, 20 nt, Artificial Sequence
  Synthetic
uuuguuaaagaaugacugug

SEQ ID NO: 21045 - RNA, 21 nt, Artificial Sequence
  Synthetic
auggcaucucaccagugugug

SEQ ID NO: 21046 - RNA, 22 nt, Artificial Sequence
  Synthetic
uauggcaucucaccagugugug

SEQ ID NO: 21047 - RNA, 23 nt, Artificial Sequence
  Synthetic
uuauggcaucucaccagugugug

SEQ ID NO: 21048 - RNA, 24 nt, Artificial Sequence
  Synthetic
cuuauggcaucucaccagugugug

SEQ ID NO: 21049 - RNA, 19 nt, Artificial Sequence
  Synthetic
ugaggagaaccauauuuug

SEQ ID NO: 21050 - RNA, 20 nt, Artificial Sequence
  Synthetic
augaggagaaccauauuuug

SEQ ID NO: 21051 - RNA, 22 nt, Artificial Sequence
  Synthetic
agaugaggagaaccauauuuug

SEQ ID NO: 21052 - RNA, 23 nt, Artificial Sequence
  Synthetic
aagaugaggagaaccauauuuug

SEQ ID NO: 21053 - RNA, 24 nt, Artificial Sequence
  Synthetic
uaagaugaggagaaccauauuuug

SEQ ID NO: 21054 - RNA, 18 nt, Artificial Sequence
  Synthetic
ccauaaauguugaauaau

SEQ ID NO: 21055 - RNA, 19 nt, Artificial Sequence
  Synthetic
cccauaaauguugaauaau

SEQ ID NO: 21056 - RNA, 22 nt, Artificial Sequence
  Synthetic
agccccauaaauguugaauaau

SEQ ID NO: 21057 - RNA, 19 nt, Artificial Sequence
  Synthetic
agauuuuuucccauguaau

SEQ ID NO: 21058 - RNA, 20 nt, Artificial Sequence
  Synthetic
cagauuuuuucccauguaau

SEQ ID NO: 21059 - RNA, 18 nt, Artificial Sequence
  Synthetic
aucacuauugauugacau

SEQ ID NO: 21060 - RNA, 19 nt, Artificial Sequence
  Synthetic
aaucacuauugauugacau

SEQ ID NO: 21061 - RNA, 21 nt, Artificial Sequence
  Synthetic
ugaaucacuauugauugacau

SEQ ID NO: 21062 - RNA, 22 nt, Artificial Sequence
  Synthetic
augaaucacuauugauugacau

SEQ ID NO: 21063 - RNA, 23 nt, Artificial Sequence
  Synthetic
aaugaaucacuauugauugacau

SEQ ID NO: 21064 - RNA, 24 nt, Artificial Sequence
  Synthetic
uaaugaaucacuauugauugacau

SEQ ID NO: 21065 - RNA, 18 nt, Artificial Sequence
  Synthetic
uaguuucuauuaauagau

SEQ ID NO: 21066 - RNA, 20 nt, Artificial Sequence
  Synthetic
uguaguuucuauuaauagau

SEQ ID NO: 21067 - RNA, 22 nt, Artificial Sequence
  Synthetic
cguguaguuucuauuaauagau

SEQ ID NO: 21068 - RNA, 23 nt, Artificial Sequence
  Synthetic
ucguguaguuucuauuaauagau

SEQ ID NO: 21069 - RNA, 24 nt, Artificial Sequence
  Synthetic
uucguguaguuucuauuaauagau

SEQ ID NO: 21070 - RNA, 19 nt, Artificial Sequence
  Synthetic
agaaagagcuuucuaguau

SEQ ID NO: 21071 - RNA, 18 nt, Artificial Sequence
  Synthetic
aaagcugugcauuuuccu

SEQ ID NO: 21072 - RNA, 19 nt, Artificial Sequence
  Synthetic
aaaagcugugcauuuuccu

SEQ ID NO: 21073 - RNA, 20 nt, Artificial Sequence
  Synthetic
aaaaagcugugcauuuuccu

SEQ ID NO: 21074 - RNA, 22 nt, Artificial Sequence
  Synthetic
uguucaaauuauuucuacugcu

SEQ ID NO: 21075 - RNA, 23 nt, Artificial Sequence
  Synthetic
uuguucaaauuauuucuacugcu

SEQ ID NO: 21076 - RNA, 18 nt, Artificial Sequence
  Synthetic
uguaggcuauauguaucu

SEQ ID NO: 21077 - RNA, 19 nt, Artificial Sequence
  Synthetic
cuguaggcuauauguaucu

SEQ ID NO: 21078 - RNA, 20 nt, Artificial Sequence
  Synthetic
ucuguaggcuauauguaucu

SEQ ID NO: 21079 - RNA, 18 nt, Artificial Sequence
  Synthetic
agacuaaggcuuauuucu

SEQ ID NO: 21080 - RNA, 19 nt, Artificial Sequence
  Synthetic
aagacuaaggcuuauuucu

SEQ ID NO: 21081 - RNA, 20 nt, Artificial Sequence
  Synthetic
aaagacuaaggcuuauuucu

SEQ ID NO: 21082 - RNA, 21 nt, Artificial Sequence
  Synthetic
uaaagacuaaggcuuauuucu

SEQ ID NO: 21083 - RNA, 23 nt, Artificial Sequence
  Synthetic
cguaaagacuaaggcuuauuucu

SEQ ID NO: 21084 - RNA, 24 nt, Artificial Sequence
  Synthetic
ucguaaagacuaaggcuuauuucu

SEQ ID NO: 21085 - RNA, 18 nt, Artificial Sequence
  Synthetic
aagaagagaaaggggugu

SEQ ID NO: 21086 - RNA, 19 nt, Artificial Sequence
  Synthetic
uaagaagagaaaggggugu

SEQ ID NO: 21087 - RNA, 22 nt, Artificial Sequence
  Synthetic
ugauaagaagagaaaggggugu

SEQ ID NO: 21088 - RNA, 23 nt, Artificial Sequence
  Synthetic
uugauaagaagagaaaggggugu

SEQ ID NO: 21089 - RNA, 19 nt, Artificial Sequence
  Synthetic
aguuguuaucucugaaauu

SEQ ID NO: 21090 - RNA, 20 nt, Artificial Sequence
  Synthetic
aaguuguuaucucugaaauu

SEQ ID NO: 21091 - RNA, 21 nt, Artificial Sequence
  Synthetic
caaguuguuaucucugaaauu

SEQ ID NO: 21092 - RNA, 22 nt, Artificial Sequence
  Synthetic
ucaaguuguuaucucugaaauu

SEQ ID NO: 21093 - RNA, 23 nt, Artificial Sequence
  Synthetic
aucaaguuguuaucucugaaauu

SEQ ID NO: 21094 - RNA, 24 nt, Artificial Sequence
  Synthetic
uaucaaguuguuaucucugaaauu

SEQ ID NO: 21095 - RNA, 18 nt, Artificial Sequence
  Synthetic
acgguaagcucaagcauu

SEQ ID NO: 21096 - RNA, 19 nt, Artificial Sequence
  Synthetic
uacgguaagcucaagcauu

SEQ ID NO: 21097 - RNA, 20 nt, Artificial Sequence
  Synthetic
uuacgguaagcucaagcauu

SEQ ID NO: 21098 - RNA, 21 nt, Artificial Sequence
  Synthetic
auuacgguaagcucaagcauu

SEQ ID NO: 21099 - RNA, 22 nt, Artificial Sequence
  Synthetic
uauuacgguaagcucaagcauu

SEQ ID NO: 21100 - RNA, 23 nt, Artificial Sequence
  Synthetic
cuauuacgguaagcucaagcauu

SEQ ID NO: 21101 - RNA, 18 nt, Artificial Sequence
  Synthetic
cugccuuuuaguaguauu

SEQ ID NO: 21102 - RNA, 21 nt, Artificial Sequence
  Synthetic
aggcugccuuuuaguaguauu

SEQ ID NO: 21103 - RNA, 24 nt, Artificial Sequence
  Synthetic
aggaggcugccuuuuaguaguauu

SEQ ID NO: 21104 - RNA, 18 nt, Artificial Sequence
  Synthetic
agauuagcuuauauacuu

SEQ ID NO: 21105 - RNA, 19 nt, Artificial Sequence
  Synthetic
uagauuagcuuauauacuu

SEQ ID NO: 21106 - RNA, 21 nt, Artificial Sequence
  Synthetic
aauagauuagcuuauauacuu

SEQ ID NO: 21107 - RNA, 23 nt, Artificial Sequence
  Synthetic
ugaauagauuagcuuauauacuu

SEQ ID NO: 21108 - RNA, 24 nt, Artificial Sequence
  Synthetic
uugaauagauuagcuuauauacuu

SEQ ID NO: 21109 - RNA, 18 nt, Artificial Sequence
  Synthetic
uuuuccaagcggucccuu

SEQ ID NO: 21110 - RNA, 19 nt, Artificial Sequence
  Synthetic
uuuuuccaagcggucccuu

SEQ ID NO: 21111 - RNA, 20 nt, Artificial Sequence
  Synthetic
uuuuuuccaagcggucccuu

SEQ ID NO: 21112 - RNA, 21 nt, Artificial Sequence
  Synthetic
uuuuuuuccaagcggucccuu

SEQ ID NO: 21113 - RNA, 22 nt, Artificial Sequence
  Synthetic
uuuuuuuuccaagcggucccuu

SEQ ID NO: 21114 - RNA, 23 nt, Artificial Sequence
  Synthetic
auuuuuuuuccaagcggucccuu

SEQ ID NO: 21115 - RNA, 24 nt, Artificial Sequence
  Synthetic
aauuuuuuuuccaagcggucccuu

SEQ ID NO: 21116 - RNA, 21 nt, Artificial Sequence
  Synthetic
agaggaaggcaguggucccuu

SEQ ID NO: 21117 - RNA, 22 nt, Artificial Sequence
  Synthetic
uagaggaaggcaguggucccuu

SEQ ID NO: 21118 - RNA, 23 nt, Artificial Sequence
  Synthetic
uuagaggaaggcaguggucccuu

SEQ ID NO: 21119 - RNA, 19 nt, Artificial Sequence
  Synthetic
agaugugcaaaaauagcuu

SEQ ID NO: 21120 - RNA, 21 nt, Artificial Sequence
  Synthetic
auagaugugcaaaaauagcuu

SEQ ID NO: 21121 - RNA, 23 nt, Artificial Sequence
  Synthetic
ugauagaugugcaaaaauagcuu

SEQ ID NO: 21122 - RNA, 24 nt, Artificial Sequence
  Synthetic
augauagaugugcaaaaauagcuu

SEQ ID NO: 21123 - RNA, 18 nt, Artificial Sequence
  Synthetic
acaugaccuuccuuucuu

SEQ ID NO: 21124 - RNA, 19 nt, Artificial Sequence
  Synthetic
uacaugaccuuccuuucuu

SEQ ID NO: 21125 - RNA, 20 nt, Artificial Sequence
  Synthetic
uuacaugaccuuccuuucuu

SEQ ID NO: 21126 - RNA, 22 nt, Artificial Sequence
  Synthetic
uguuacaugaccuuccuuucuu

SEQ ID NO: 21127 - RNA, 23 nt, Artificial Sequence
  Synthetic
cuguuacaugaccuuccuuucuu

SEQ ID NO: 21128 - RNA, 24 nt, Artificial Sequence
  Synthetic
ucuguuacaugaccuuccuuucuu

SEQ ID NO: 21129 - RNA, 18 nt, Artificial Sequence
  Synthetic
uaaugggagaaacagguu

SEQ ID NO: 21130 - RNA, 19 nt, Artificial Sequence
  Synthetic
auaaugggagaaacagguu

SEQ ID NO: 21131 - RNA, 19 nt, Artificial Sequence
  Synthetic
agcacuggaguuaccuguu

SEQ ID NO: 21132 - RNA, 20 nt, Artificial Sequence
  Synthetic
uagcacuggaguuaccuguu

SEQ ID NO: 21133 - RNA, 21 nt, Artificial Sequence
  Synthetic
auagcacuggaguuaccuguu

SEQ ID NO: 21134 - RNA, 22 nt, Artificial Sequence
  Synthetic
aauagcacuggaguuaccuguu

SEQ ID NO: 21135 - RNA, 23 nt, Artificial Sequence
  Synthetic
aaauagcacuggaguuaccuguu

SEQ ID NO: 21136 - RNA, 24 nt, Artificial Sequence
  Synthetic
uaaauagcacuggaguuaccuguu

SEQ ID NO: 21137 - RNA, 21 nt, Artificial Sequence
  Synthetic
caaauaguuuuaucaauauuu

SEQ ID NO: 21138 - RNA, 23 nt, Artificial Sequence
  Synthetic
ugcaaauaguuuuaucaauauuu

SEQ ID NO: 21139 - RNA, 24 nt, Artificial Sequence
  Synthetic
cugcaaauaguuuuaucaauauuu

SEQ ID NO: 21140 - RNA, 18 nt, Artificial Sequence
  Synthetic
uuggauggagcuugguuu

SEQ ID NO: 21141 - RNA, 19 nt, Artificial Sequence
  Synthetic
uuuggauggagcuugguuu

SEQ ID NO: 21142 - RNA, 23 nt, Artificial Sequence
  Synthetic
agguuuuggauggagcuugguuu

SEQ ID NO: 21143 - RNA, 24 nt, Artificial Sequence
  Synthetic
cagguuuuggauggagcuugguuu

SEQ ID NO: 21144 - RNA, 19 nt, Artificial Sequence
  Synthetic
uguccuccacaaauauuuu

SEQ ID NO: 21145 - RNA, 20 nt, Artificial Sequence
  Synthetic
auguccuccacaaauauuuu

SEQ ID NO: 21146 - RNA, 19 nt, Artificial Sequence
  Synthetic
guaagaccuaaucucuaaa

SEQ ID NO: 21147 - RNA, 21 nt, Artificial Sequence
  Synthetic
gaguaagaccuaaucucuaaa

SEQ ID NO: 21148 - RNA, 23 nt, Artificial Sequence
  Synthetic
gacagaugagagacaguaaagaa

SEQ ID NO: 21149 - RNA, 24 nt, Artificial Sequence
  Synthetic
ggacagaugagagacaguaaagaa

SEQ ID NO: 21150 - RNA, 19 nt, Artificial Sequence
  Synthetic
guguucucacauggcagaa

SEQ ID NO: 21151 - RNA, 22 nt, Artificial Sequence
  Synthetic
gcuguguucucacauggcagaa

SEQ ID NO: 21152 - RNA, 24 nt, Artificial Sequence
  Synthetic
guucuuagggugggauauggagaa

SEQ ID NO: 21153 - RNA, 18 nt, Artificial Sequence
  Synthetic
gaagaaaaguaucaauaa

SEQ ID NO: 21154 - RNA, 19 nt, Artificial Sequence
  Synthetic
ggaagaaaaguaucaauaa

SEQ ID NO: 21155 - RNA, 21 nt, Artificial Sequence
  Synthetic
guuuuuaccauuaucuacaca

SEQ ID NO: 21156 - RNA, 22 nt, Artificial Sequence
  Synthetic
gauauggagaagaggaugacca

SEQ ID NO: 21157 - RNA, 23 nt, Artificial Sequence
  Synthetic
ggauauggagaagaggaugacca

SEQ ID NO: 21158 - RNA, 24 nt, Artificial Sequence
  Synthetic
gggauauggagaagaggaugacca

SEQ ID NO: 21159 - RNA, 18 nt, Artificial Sequence
  Synthetic
gaaguucagccuggguga

SEQ ID NO: 21160 - RNA, 21 nt, Artificial Sequence
  Synthetic
gcaaaaauuacagaaccuaua

SEQ ID NO: 21161 - RNA, 24 nt, Artificial Sequence
  Synthetic
gaagcaaaaauuacagaaccuaua

SEQ ID NO: 21162 - RNA, 21 nt, Artificial Sequence
  Synthetic
gcuuccucccuugucucccua

SEQ ID NO: 21163 - RNA, 22 nt, Artificial Sequence
  Synthetic
gucuucucagacuuuuauuuua

SEQ ID NO: 21164 - RNA, 18 nt, Artificial Sequence
  Synthetic
guuuccaaauuuuuuuua

SEQ ID NO: 21165 - RNA, 23 nt, Artificial Sequence
  Synthetic
gacaaguuuccaaauuuuuuuua

SEQ ID NO: 21166 - RNA, 18 nt, Artificial Sequence
  Synthetic
guguggcuuauaaacaac

SEQ ID NO: 21167 - RNA, 23 nt, Artificial Sequence
  Synthetic
gaacuguguggcuuauaaacaac

SEQ ID NO: 21168 - RNA, 21 nt, Artificial Sequence
  Synthetic
gaagauacuaaaaaaaguuac

SEQ ID NO: 21169 - RNA, 22 nt, Artificial Sequence
  Synthetic
ggaagauacuaaaaaaaguuac

SEQ ID NO: 21170 - RNA, 23 nt, Artificial Sequence
  Synthetic
gggaagauacuaaaaaaaguuac

SEQ ID NO: 21171 - RNA, 18 nt, Artificial Sequence
  Synthetic
gaaaggucaauugagccc

SEQ ID NO: 21172 - RNA, 19 nt, Artificial Sequence
  Synthetic
ggaaaggucaauugagccc

SEQ ID NO: 21173 - RNA, 21 nt, Artificial Sequence
  Synthetic
gcggaaaggucaauugagccc

SEQ ID NO: 21174 - RNA, 24 nt, Artificial Sequence
  Synthetic
gaagcggaaaggucaauugagccc

SEQ ID NO: 21175 - RNA, 20 nt, Artificial Sequence
  Synthetic
gcuacuuggaagacucuucc

SEQ ID NO: 21176 - RNA, 22 nt, Artificial Sequence
  Synthetic
gaucacaccacugaaguucagc

SEQ ID NO: 21177 - RNA, 18 nt, Artificial Sequence
  Synthetic
gaguuucacuguguuagc

SEQ ID NO: 21178 - RNA, 19 nt, Artificial Sequence
  Synthetic
ggaguuucacuguguuagc

SEQ ID NO: 21179 - RNA, 22 nt, Artificial Sequence
  Synthetic
gacggaguuucacuguguuagc

SEQ ID NO: 21180 - RNA, 24 nt, Artificial Sequence
  Synthetic
gagacggaguuucacuguguuagc

SEQ ID NO: 21181 - RNA, 21 nt, Artificial Sequence
  Synthetic
gucucacucugucacccaggc

SEQ ID NO: 21182 - RNA, 23 nt, Artificial Sequence
  Synthetic
gagucucacucugucacccaggc

SEQ ID NO: 21183 - RNA, 20 nt, Artificial Sequence
  Synthetic
gccucugccuccaaaagugc

SEQ ID NO: 21184 - RNA, 22 nt, Artificial Sequence
  Synthetic
gccauucuccugccucagccuc

SEQ ID NO: 21185 - RNA, 21 nt, Artificial Sequence
  Synthetic
gcucacugcaaguucugccuc

SEQ ID NO: 21186 - RNA, 22 nt, Artificial Sequence
  Synthetic
ggcucacugcaaguucugccuc

SEQ ID NO: 21187 - RNA, 21 nt, Artificial Sequence
  Synthetic
gaucuuccuucaaagcauguc

SEQ ID NO: 21188 - RNA, 22 nt, Artificial Sequence
  Synthetic
ggaucuuccuucaaagcauguc

SEQ ID NO: 21189 - RNA, 22 nt, Artificial Sequence
  Synthetic
gugauauuuuucauuaugauuc

SEQ ID NO: 21190 - RNA, 23 nt, Artificial Sequence
  Synthetic
ggugauauuuuucauuaugauuc

SEQ ID NO: 21191 - RNA, 22 nt, Artificial Sequence
  Synthetic
gcuacuugggaggcugaggcag

SEQ ID NO: 21192 - RNA, 22 nt, Artificial Sequence
  Synthetic
gcuacuugggagggugaggcag

SEQ ID NO: 21193 - RNA, 22 nt, Artificial Sequence
  Synthetic
gcacuuugggaggccgaggcgg

SEQ ID NO: 21194 - RNA, 22 nt, Artificial Sequence
  Synthetic
gaacaaaaauuaaaacuaaugg

SEQ ID NO: 21195 - RNA, 24 nt, Artificial Sequence
  Synthetic
gugaacaaaaauuaaaacuaaugg

SEQ ID NO: 21196 - RNA, 18 nt, Artificial Sequence
  Synthetic
guagucccagcuacuugg

SEQ ID NO: 21197 - RNA, 22 nt, Artificial Sequence
  Synthetic
gccuguagucccagcuacuugg

SEQ ID NO: 21198 - RNA, 24 nt, Artificial Sequence
  Synthetic
gugccuguagucccagcuacuugg

SEQ ID NO: 21199 - RNA, 22 nt, Artificial Sequence
  Synthetic
gcaauaccaucaccuugggaau

SEQ ID NO: 21200 - RNA, 18 nt, Artificial Sequence
  Synthetic
gaauuaggauuucaacau

SEQ ID NO: 21201 - RNA, 19 nt, Artificial Sequence
  Synthetic
ggaauuaggauuucaacau

SEQ ID NO: 21202 - RNA, 20 nt, Artificial Sequence
  Synthetic
gggaauuaggauuucaacau

SEQ ID NO: 21203 - RNA, 19 nt, Artificial Sequence
  Synthetic
gaucaaggugccagcagau

SEQ ID NO: 21204 - RNA, 19 nt, Artificial Sequence
  Synthetic
gugauaguugcacaacuau

SEQ ID NO: 21205 - RNA, 20 nt, Artificial Sequence
  Synthetic
ggugauaguugcacaacuau

SEQ ID NO: 21206 - RNA, 22 nt, Artificial Sequence
  Synthetic
gaggugauaguugcacaacuau

SEQ ID NO: 21207 - RNA, 23 nt, Artificial Sequence
  Synthetic
ggaggugauaguugcacaacuau

SEQ ID NO: 21208 - RNA, 23 nt, Artificial Sequence
  Synthetic
guuuauuuacauuucucuuuacu

SEQ ID NO: 21209 - RNA, 20 nt, Artificial Sequence
  Synthetic
gaaaauguuaaauuuucccu

SEQ ID NO: 21210 - RNA, 23 nt, Artificial Sequence
  Synthetic
gaaauuuaauugccaguaagucu

SEQ ID NO: 21211 - RNA, 23 nt, Artificial Sequence
  Synthetic
guucucacauggcagaaaggggu

SEQ ID NO: 21212 - RNA, 21 nt, Artificial Sequence
  Synthetic
gcaucacuaguggcacuuugu

SEQ ID NO: 21213 - RNA, 23 nt, Artificial Sequence
  Synthetic
gugcaucacuaguggcacuuugu

SEQ ID NO: 21214 - RNA, 23 nt, Artificial Sequence
  Synthetic
gacccuuuaucaacaugaagguu

SEQ ID NO: 21215 - RNA, 23 nt, Artificial Sequence
  Synthetic
gaaauauagauuuaaucuuauuu

SEQ ID NO: 21216 - RNA, 24 nt, Artificial Sequence
  Synthetic
ggaaauauagauuuaaucuuauuu

SEQ ID NO: 21217 - RNA, 22 nt, Artificial Sequence
  Synthetic
guauuucuaggcuagacaguuu

SEQ ID NO: 21218 - RNA, 23 nt, Artificial Sequence
  Synthetic
gguauuucuaggcuagacaguuu

SEQ ID NO: 21219 - RNA, 19 nt, Artificial Sequence
  Synthetic
guucaagccuguauuguuu

SEQ ID NO: 21220 - RNA, 22 nt, Artificial Sequence
  Synthetic
gcaguucaagccuguauuguuu

SEQ ID NO: 21221 - RNA, 24 nt, Artificial Sequence
  Synthetic
gaauauuuaaacacuucugagaaa

SEQ ID NO: 21222 - RNA, 24 nt, Artificial Sequence
  Synthetic
gacaugcuuugaaggaagauccaa

SEQ ID NO: 21223 - RNA, 18 nt, Artificial Sequence
  Synthetic
gaaccauauuuugaagaa

SEQ ID NO: 21224 - RNA, 20 nt, Artificial Sequence
  Synthetic
gagaaccauauuuugaagaa

SEQ ID NO: 21225 - RNA, 19 nt, Artificial Sequence
  Synthetic
guauauuauagaaauuuaa

SEQ ID NO: 21226 - RNA, 20 nt, Artificial Sequence
  Synthetic
gguauauuauagaaauuuaa

SEQ ID NO: 21227 - RNA, 24 nt, Artificial Sequence
  Synthetic
gacagguauauuauagaaauuuaa

SEQ ID NO: 21228 - RNA, 19 nt, Artificial Sequence
  Synthetic
guggauuuuugacuauaca

SEQ ID NO: 21229 - RNA, 19 nt, Artificial Sequence
  Synthetic
gaggucacugaggcuggca

SEQ ID NO: 21230 - RNA, 20 nt, Artificial Sequence
  Synthetic
ggaggucacugaggcuggca

SEQ ID NO: 21231 - RNA, 24 nt, Artificial Sequence
  Synthetic
guaaggaggucacugaggcuggca

SEQ ID NO: 21232 - RNA, 21 nt, Artificial Sequence
  Synthetic
gauaugaaguuaaaaacauca

SEQ ID NO: 21233 - RNA, 23 nt, Artificial Sequence
  Synthetic
gagauaugaaguuaaaaacauca

SEQ ID NO: 21234 - RNA, 24 nt, Artificial Sequence
  Synthetic
ggagauaugaaguuaaaaacauca

SEQ ID NO: 21235 - RNA, 18 nt, Artificial Sequence
  Synthetic
gaccagaaugaaauuaga

SEQ ID NO: 21236 - RNA, 21 nt, Artificial Sequence
  Synthetic
gaugauuccaagcuuucugga

SEQ ID NO: 21237 - RNA, 21 nt, Artificial Sequence
  Synthetic
gaaauaaauuuaaagacauga

SEQ ID NO: 21238 - RNA, 22 nt, Artificial Sequence
  Synthetic
ggaaauaaauuuaaagacauga

SEQ ID NO: 21239 - RNA, 24 nt, Artificial Sequence
  Synthetic
gaggaaauaaauuuaaagacauga

SEQ ID NO: 21240 - RNA, 19 nt, Artificial Sequence
  Synthetic
gagaagacaaagcuaguga

SEQ ID NO: 21241 - RNA, 23 nt, Artificial Sequence
  Synthetic
gucugagaagacaaagcuaguga

SEQ ID NO: 21242 - RNA, 18 nt, Artificial Sequence
  Synthetic
gcacucuagccuggguga

SEQ ID NO: 21243 - RNA, 24 nt, Artificial Sequence
  Synthetic
gccacugcacucuagccuggguga

SEQ ID NO: 21244 - RNA, 24 nt, Artificial Sequence
  Synthetic
gcaccccuaaccuucauguugaua

SEQ ID NO: 21245 - RNA, 23 nt, Artificial Sequence
  Synthetic
gacuugcaggaggugagggauua

SEQ ID NO: 21246 - RNA, 19 nt, Artificial Sequence
  Synthetic
gccaauaaaagguuuguua

SEQ ID NO: 21247 - RNA, 19 nt, Artificial Sequence
  Synthetic
gcauauauauauuuuuaac

SEQ ID NO: 21248 - RNA, 19 nt, Artificial Sequence
  Synthetic
guggagucaaaaauuauac

SEQ ID NO: 21249 - RNA, 22 nt, Artificial Sequence
  Synthetic
guuuagugcaaugccauaaacc

SEQ ID NO: 21250 - RNA, 18 nt, Artificial Sequence
  Synthetic
gaaaaaguaagauaugcc

SEQ ID NO: 21251 - RNA, 18 nt, Artificial Sequence
  Synthetic
ggugaauugcuugagucc

SEQ ID NO: 21252 - RNA, 21 nt, Artificial Sequence
  Synthetic
gcaggugaauugcuugagucc

SEQ ID NO: 21253 - RNA, 22 nt, Artificial Sequence
  Synthetic
ggcaggugaauugcuugagucc

SEQ ID NO: 21254 - RNA, 24 nt, Artificial Sequence
  Synthetic
gaggcaggugaauugcuugagucc

SEQ ID NO: 21255 - RNA, 24 nt, Artificial Sequence
  Synthetic
gaaaacaaauuuucuuuguuuucc

SEQ ID NO: 21256 - RNA, 18 nt, Artificial Sequence
  Synthetic
gcgccacugcacucuagc

SEQ ID NO: 21257 - RNA, 22 nt, Artificial Sequence
  Synthetic
gaucgcgccacugcacucuagc

SEQ ID NO: 21258 - RNA, 24 nt, Artificial Sequence
  Synthetic
gagaucgcgccacugcacucuagc

SEQ ID NO: 21259 - RNA, 18 nt, Artificial Sequence
  Synthetic
ggguuucaccguuuuagc

SEQ ID NO: 21260 - RNA, 19 nt, Artificial Sequence
  Synthetic
gggguuucaccguuuuagc

SEQ ID NO: 21261 - RNA, 22 nt, Artificial Sequence
  Synthetic
gacgggguuucaccguuuuagc

SEQ ID NO: 21262 - RNA, 24 nt, Artificial Sequence
  Synthetic
gagacgggguuucaccguuuuagc

SEQ ID NO: 21263 - RNA, 21 nt, Artificial Sequence
  Synthetic
gucucgcucugucgcccaggc

SEQ ID NO: 21264 - RNA, 23 nt, Artificial Sequence
  Synthetic
gagucucgcucugucgcccaggc

SEQ ID NO: 21265 - RNA, 24 nt, Artificial Sequence
  Synthetic
ggagucucgcucugucgcccaggc

SEQ ID NO: 21266 - RNA, 18 nt, Artificial Sequence
  Synthetic
ggguuucaccauguuggc

SEQ ID NO: 21267 - RNA, 19 nt, Artificial Sequence
  Synthetic
gggguuucaccauguuggc

SEQ ID NO: 21268 - RNA, 22 nt, Artificial Sequence
  Synthetic
gacgggguuucaccauguuggc

SEQ ID NO: 21269 - RNA, 24 nt, Artificial Sequence
  Synthetic
gagacgggguuucaccauguuggc

SEQ ID NO: 21270 - RNA, 24 nt, Artificial Sequence
  Synthetic
gcccgccucggccucccaaagugc

SEQ ID NO: 21271 - RNA, 19 nt, Artificial Sequence
  Synthetic
gcagaggcaggugaauugc

SEQ ID NO: 21272 - RNA, 20 nt, Artificial Sequence
  Synthetic
ggcagaggcaggugaauugc

SEQ ID NO: 21273 - RNA, 22 nt, Artificial Sequence
  Synthetic
gaggcagaggcaggugaauugc

SEQ ID NO: 21274 - RNA, 23 nt, Artificial Sequence
  Synthetic
ggaggcagaggcaggugaauugc

SEQ ID NO: 21275 - RNA, 21 nt, Artificial Sequence
  Synthetic
gcucacugcaagcuccgccuc

SEQ ID NO: 21276 - RNA, 22 nt, Artificial Sequence
  Synthetic
ggcucacugcaagcuccgccuc

SEQ ID NO: 21277 - RNA, 23 nt, Artificial Sequence
  Synthetic
guuguaacaguacaagaaaaaag

SEQ ID NO: 21278 - RNA, 22 nt, Artificial Sequence
  Synthetic
gcuuugccauuaacagauaaag

SEQ ID NO: 21279 - RNA, 22 nt, Artificial Sequence
  Synthetic
gcacuuuuggaggcagaggcag

SEQ ID NO: 21280 - RNA, 22 nt, Artificial Sequence
  Synthetic
gcuacucgggaggcugaggcag

SEQ ID NO: 21281 - RNA, 21 nt, Artificial Sequence
  Synthetic
gacaagggaggaagcaaggag

SEQ ID NO: 21282 - RNA, 23 nt, Artificial Sequence
  Synthetic
gagacaagggaggaagcaaggag

SEQ ID NO: 21283 - RNA, 24 nt, Artificial Sequence
  Synthetic
ggagacaagggaggaagcaaggag

SEQ ID NO: 21284 - RNA, 22 nt, Artificial Sequence
  Synthetic
gacauccaaauagagauguuag

SEQ ID NO: 21285 - RNA, 22 nt, Artificial Sequence
  Synthetic
gcauagaguaagacagggaggg

SEQ ID NO: 21286 - RNA, 23 nt, Artificial Sequence
  Synthetic
ggcauagaguaagacagggaggg

SEQ ID NO: 21287 - RNA, 21 nt, Artificial Sequence
  Synthetic
gcauaguauucuaucauaugg

SEQ ID NO: 21288 - RNA, 24 nt, Artificial Sequence
  Synthetic
gaugcauaguauucuaucauaugg

SEQ ID NO: 21289 - RNA, 22 nt, Artificial Sequence
  Synthetic
gcuuucuggacugaguaacugg

SEQ ID NO: 21290 - RNA, 18 nt, Artificial Sequence
  Synthetic
guauauaugugugucugg

SEQ ID NO: 21291 - RNA, 22 nt, Artificial Sequence
  Synthetic
guauguauauaugugugucugg

SEQ ID NO: 21292 - RNA, 21 nt, Artificial Sequence
  Synthetic
gcccaggcuggagugcagugg

SEQ ID NO: 21293 - RNA, 24 nt, Artificial Sequence
  Synthetic
gucgcccaggcuggagugcagugg

SEQ ID NO: 21294 - RNA, 22 nt, Artificial Sequence
  Synthetic
gcuacuugggaggcugaggugg

SEQ ID NO: 21295 - RNA, 21 nt, Artificial Sequence
  Synthetic
ggugggggagccccauaaaug

SEQ ID NO: 21296 - RNA, 22 nt, Artificial Sequence
  Synthetic
gggugggggagccccauaaaug

SEQ ID NO: 21297 - RNA, 21 nt, Artificial Sequence
  Synthetic
gggugagauuagaggccacug

SEQ ID NO: 21298 - RNA, 19 nt, Artificial Sequence
  Synthetic
gcuucagccucccaaagug

SEQ ID NO: 21299 - RNA, 22 nt, Artificial Sequence
  Synthetic
gaacaaagacuugcaggaggug

SEQ ID NO: 21300 - RNA, 21 nt, Artificial Sequence
  Synthetic
guuuguuaaagaaugacugug

SEQ ID NO: 21301 - RNA, 22 nt, Artificial Sequence
  Synthetic
gguuuguuaaagaaugacugug

SEQ ID NO: 21302 - RNA, 22 nt, Artificial Sequence
  Synthetic
gcuauuaguaguuaaguuuuug

SEQ ID NO: 21303 - RNA, 23 nt, Artificial Sequence
  Synthetic
ggcuauuaguaguuaaguuuuug

SEQ ID NO: 21304 - RNA, 18 nt, Artificial Sequence
  Synthetic
gggaggugauuaguccau

SEQ ID NO: 21305 - RNA, 24 nt, Artificial Sequence
  Synthetic
gccuuugggaggugauuaguccau

SEQ ID NO: 21306 - RNA, 20 nt, Artificial Sequence
  Synthetic
gaugcauaguauucuaucau

SEQ ID NO: 21307 - RNA, 23 nt, Artificial Sequence
  Synthetic
gaugagaaagagcuuucuaguau

SEQ ID NO: 21308 - RNA, 21 nt, Artificial Sequence
  Synthetic
gucuguaggcuauauguaucu

SEQ ID NO: 21309 - RNA, 24 nt, Artificial Sequence
  Synthetic
gccugccucggccucccaaagugu

SEQ ID NO: 21310 - RNA, 18 nt, Artificial Sequence
  Synthetic
ggaaggcaguggucccuu

SEQ ID NO: 21311 - RNA, 18 nt, Artificial Sequence
  Synthetic
gaagcaaggagaugaguu

SEQ ID NO: 21312 - RNA, 19 nt, Artificial Sequence
  Synthetic
ggaagcaaggagaugaguu

SEQ ID NO: 21313 - RNA, 21 nt, Artificial Sequence
  Synthetic
gaggaagcaaggagaugaguu

SEQ ID NO: 21314 - RNA, 22 nt, Artificial Sequence
  Synthetic
ggaggaagcaaggagaugaguu

SEQ ID NO: 21315 - RNA, 23 nt, Artificial Sequence
  Synthetic
gggaggaagcaaggagaugaguu

SEQ ID NO: 21316 - RNA, 24 nt, Artificial Sequence
  Synthetic
gaaagauaaugggagaaacagguu

SEQ ID NO: 21317 - RNA, 18 nt, Artificial Sequence
  Synthetic
gcauggguccacuuauuu

SEQ ID NO: 21318 - RNA, 23 nt, Artificial Sequence
  Synthetic
gaacugcauggguccacuuauuu

SEQ ID NO: 21319 - RNA, 24 nt, Artificial Sequence
  Synthetic
gcuuuuuuguuguuuuucuaguuu

SEQ ID NO: 21320 - RNA, 21 nt, Artificial Sequence
  Synthetic
guuaauacauuggaaaauuuu

SEQ ID NO: 21321 - RNA, 22 nt, Artificial Sequence
  Synthetic
guauguccuccacaaauauuuu

SEQ ID NO: 21322 - RNA, 18 nt, Artificial Sequence
  Synthetic
caaaaaagcgaagaaaaa

SEQ ID NO: 21323 - RNA, 19 nt, Artificial Sequence
  Synthetic
acaaaaaagcgaagaaaaa

SEQ ID NO: 21324 - RNA, 20 nt, Artificial Sequence
  Synthetic
aacaaaaaagcgaagaaaaa

SEQ ID NO: 21325 - RNA, 21 nt, Artificial Sequence
  Synthetic
caacaaaaaagcgaagaaaaa

SEQ ID NO: 21326 - RNA, 22 nt, Artificial Sequence
  Synthetic
acaacaaaaaagcgaagaaaaa

SEQ ID NO: 21327 - RNA, 23 nt, Artificial Sequence
  Synthetic
aacaacaaaaaagcgaagaaaaa

SEQ ID NO: 21328 - RNA, 24 nt, Artificial Sequence
  Synthetic
aaacaacaaaaaagcgaagaaaaa

SEQ ID NO: 21329 - RNA, 21 nt, Artificial Sequence
  Synthetic
auacauaugauuuuaugaaaa

SEQ ID NO: 21330 - RNA, 22 nt, Artificial Sequence
  Synthetic
cauacauaugauuuuaugaaaa

SEQ ID NO: 21331 - RNA, 23 nt, Artificial Sequence
  Synthetic
acauacauaugauuuuaugaaaa

SEQ ID NO: 21332 - RNA, 24 nt, Artificial Sequence
  Synthetic
uacauacauaugauuuuaugaaaa

SEQ ID NO: 21333 - RNA, 21 nt, Artificial Sequence
  Synthetic
agauaauacuacugacuaaaa

SEQ ID NO: 21334 - RNA, 22 nt, Artificial Sequence
  Synthetic
aagauaauacuacugacuaaaa

SEQ ID NO: 21335 - RNA, 23 nt, Artificial Sequence
  Synthetic
aaagauaauacuacugacuaaaa

SEQ ID NO: 21336 - RNA, 24 nt, Artificial Sequence
  Synthetic
aaaagauaauacuacugacuaaaa

SEQ ID NO: 21337 - RNA, 18 nt, Artificial Sequence
  Synthetic
auaaacaaacaaaggaaa

SEQ ID NO: 21338 - RNA, 19 nt, Artificial Sequence
  Synthetic
aauaaacaaacaaaggaaa

SEQ ID NO: 21339 - RNA, 21 nt, Artificial Sequence
  Synthetic
caaauaaacaaacaaaggaaa

SEQ ID NO: 21340 - RNA, 22 nt, Artificial Sequence
  Synthetic
ccaaauaaacaaacaaaggaaa

SEQ ID NO: 21341 - RNA, 23 nt, Artificial Sequence
  Synthetic
accaaauaaacaaacaaaggaaa

SEQ ID NO: 21342 - RNA, 24 nt, Artificial Sequence
  Synthetic
aaccaaauaaacaaacaaaggaaa

SEQ ID NO: 21343 - RNA, 18 nt, Artificial Sequence
  Synthetic
uaagaccuaaucucuaaa

SEQ ID NO: 21344 - RNA, 20 nt, Artificial Sequence
  Synthetic
aguaagaccuaaucucuaaa

SEQ ID NO: 21345 - RNA, 22 nt, Artificial Sequence
  Synthetic
agaguaagaccuaaucucuaaa

SEQ ID NO: 21346 - RNA, 23 nt, Artificial Sequence
  Synthetic
cagaguaagaccuaaucucuaaa

SEQ ID NO: 21347 - RNA, 24 nt, Artificial Sequence
  Synthetic
acagaguaagaccuaaucucuaaa

SEQ ID NO: 21348 - RNA, 21 nt, Artificial Sequence
  Synthetic
cagaugagagacaguaaagaa

SEQ ID NO: 21349 - RNA, 22 nt, Artificial Sequence
  Synthetic
acagaugagagacaguaaagaa

SEQ ID NO: 21350 - RNA, 18 nt, Artificial Sequence
  Synthetic
uguucucacauggcagaa

SEQ ID NO: 21351 - RNA, 21 nt, Artificial Sequence
  Synthetic
cuguguucucacauggcagaa

SEQ ID NO: 21352 - RNA, 23 nt, Artificial Sequence
  Synthetic
ugcuguguucucacauggcagaa

SEQ ID NO: 21353 - RNA, 24 nt, Artificial Sequence
  Synthetic
cugcuguguucucacauggcagaa

SEQ ID NO: 21354 - RNA, 21 nt, Artificial Sequence
  Synthetic
cuuagggugggauauggagaa

SEQ ID NO: 21355 - RNA, 22 nt, Artificial Sequence
  Synthetic
ucuuagggugggauauggagaa

SEQ ID NO: 21356 - RNA, 23 nt, Artificial Sequence
  Synthetic
uucuuagggugggauauggagaa

SEQ ID NO: 21357 - RNA, 21 nt, Artificial Sequence
  Synthetic
caggaagaaaaguaucaauaa

SEQ ID NO: 21358 - RNA, 22 nt, Artificial Sequence
  Synthetic
ucaggaagaaaaguaucaauaa

SEQ ID NO: 21359 - RNA, 23 nt, Artificial Sequence
  Synthetic
aucaggaagaaaaguaucaauaa

SEQ ID NO: 21360 - RNA, 24 nt, Artificial Sequence
  Synthetic
aaucaggaagaaaaguaucaauaa

SEQ ID NO: 21361 - RNA, 22 nt, Artificial Sequence
  Synthetic
aguuuuuaccauuaucuacaca

SEQ ID NO: 21362 - RNA, 23 nt, Artificial Sequence
  Synthetic
aaguuuuuaccauuaucuacaca

SEQ ID NO: 21363 - RNA, 24 nt, Artificial Sequence
  Synthetic
caaguuuuuaccauuaucuacaca

SEQ ID NO: 21364 - RNA, 21 nt, Artificial Sequence
  Synthetic
auauggagaagaggaugacca

SEQ ID NO: 21365 - RNA, 21 nt, Artificial Sequence
  Synthetic
aaaagagacacaccuaaagca

SEQ ID NO: 21366 - RNA, 22 nt, Artificial Sequence
  Synthetic
uaaaagagacacaccuaaagca

SEQ ID NO: 21367 - RNA, 23 nt, Artificial Sequence
  Synthetic
cuaaaagagacacaccuaaagca

SEQ ID NO: 21368 - RNA, 24 nt, Artificial Sequence
  Synthetic
acuaaaagagacacaccuaaagca

SEQ ID NO: 21369 - RNA, 21 nt, Artificial Sequence
  Synthetic
caauagugauucauuauauca

SEQ ID NO: 21370 - RNA, 22 nt, Artificial Sequence
  Synthetic
ucaauagugauucauuauauca

SEQ ID NO: 21371 - RNA, 23 nt, Artificial Sequence
  Synthetic
aucaauagugauucauuauauca

SEQ ID NO: 21372 - RNA, 24 nt, Artificial Sequence
  Synthetic
aaucaauagugauucauuauauca

SEQ ID NO: 21373 - RNA, 18 nt, Artificial Sequence
  Synthetic
uuguauuuuuaguagaga

SEQ ID NO: 21374 - RNA, 19 nt, Artificial Sequence
  Synthetic
uuuguauuuuuaguagaga

SEQ ID NO: 21375 - RNA, 21 nt, Artificial Sequence
  Synthetic
uuuuuguauuuuuaguagaga

SEQ ID NO: 21376 - RNA, 22 nt, Artificial Sequence
  Synthetic
uuuuuuguauuuuuaguagaga

SEQ ID NO: 21377 - RNA, 23 nt, Artificial Sequence
  Synthetic
auuuuuuguauuuuuaguagaga

SEQ ID NO: 21378 - RNA, 24 nt, Artificial Sequence
  Synthetic
aauuuuuuguauuuuuaguagaga

SEQ ID NO: 21379 - RNA, 18 nt, Artificial Sequence
  Synthetic
uauuuauuuauuuagaga

SEQ ID NO: 21380 - RNA, 19 nt, Artificial Sequence
  Synthetic
uuauuuauuuauuuagaga

SEQ ID NO: 21381 - RNA, 20 nt, Artificial Sequence
  Synthetic
uuuauuuauuuauuuagaga

SEQ ID NO: 21382 - RNA, 21 nt, Artificial Sequence
  Synthetic
auuuauuuauuuauuuagaga

SEQ ID NO: 21383 - RNA, 22 nt, Artificial Sequence
  Synthetic
uauuuauuuauuuauuuagaga

SEQ ID NO: 21384 - RNA, 23 nt, Artificial Sequence
  Synthetic
uuauuuauuuauuuauuuagaga

SEQ ID NO: 21385 - RNA, 24 nt, Artificial Sequence
  Synthetic
uuuauuuauuuauuuauuuagaga

SEQ ID NO: 21386 - RNA, 21 nt, Artificial Sequence
  Synthetic
acuaaaaggcagccuccuaga

SEQ ID NO: 21387 - RNA, 22 nt, Artificial Sequence
  Synthetic
uacuaaaaggcagccuccuaga

SEQ ID NO: 21388 - RNA, 23 nt, Artificial Sequence
  Synthetic
cuacuaaaaggcagccuccuaga

SEQ ID NO: 21389 - RNA, 24 nt, Artificial Sequence
  Synthetic
acuacuaaaaggcagccuccuaga

SEQ ID NO: 21390 - RNA, 19 nt, Artificial Sequence
  Synthetic
ugaaguucagccuggguga

SEQ ID NO: 21391 - RNA, 20 nt, Artificial Sequence
  Synthetic
cugaaguucagccuggguga

SEQ ID NO: 21392 - RNA, 21 nt, Artificial Sequence
  Synthetic
acugaaguucagccuggguga

SEQ ID NO: 21393 - RNA, 22 nt, Artificial Sequence
  Synthetic
cacugaaguucagccuggguga

SEQ ID NO: 21394 - RNA, 23 nt, Artificial Sequence
  Synthetic
ccacugaaguucagccuggguga

SEQ ID NO: 21395 - RNA, 24 nt, Artificial Sequence
  Synthetic
accacugaaguucagccuggguga

SEQ ID NO: 21396 - RNA, 21 nt, Artificial Sequence
  Synthetic
caaauuaccaaauuguauuga

SEQ ID NO: 21397 - RNA, 22 nt, Artificial Sequence
  Synthetic
acaaauuaccaaauuguauuga

SEQ ID NO: 21398 - RNA, 23 nt, Artificial Sequence
  Synthetic
uacaaauuaccaaauuguauuga

SEQ ID NO: 21399 - RNA, 24 nt, Artificial Sequence
  Synthetic
auacaaauuaccaaauuguauuga

SEQ ID NO: 21400 - RNA, 22 nt, Artificial Sequence
  Synthetic
agcaaaaauuacagaaccuaua

SEQ ID NO: 21401 - RNA, 23 nt, Artificial Sequence
  Synthetic
aagcaaaaauuacagaaccuaua

SEQ ID NO: 21402 - RNA, 21 nt, Artificial Sequence
  Synthetic
uuuguuacaacagucuuuaua

SEQ ID NO: 21403 - RNA, 22 nt, Artificial Sequence
  Synthetic
uuuuguuacaacagucuuuaua

SEQ ID NO: 21404 - RNA, 23 nt, Artificial Sequence
  Synthetic
cuuuuguuacaacagucuuuaua

SEQ ID NO: 21405 - RNA, 24 nt, Artificial Sequence
  Synthetic
ucuuuuguuacaacagucuuuaua

SEQ ID NO: 21406 - RNA, 22 nt, Artificial Sequence
  Synthetic
ugcuuccucccuugucucccua

SEQ ID NO: 21407 - RNA, 23 nt, Artificial Sequence
  Synthetic
uugcuuccucccuugucucccua

SEQ ID NO: 21408 - RNA, 24 nt, Artificial Sequence
  Synthetic
cuugcuuccucccuugucucccua

SEQ ID NO: 21409 - RNA, 18 nt, Artificial Sequence
  Synthetic
ccuuuguacauuuuccua

SEQ ID NO: 21410 - RNA, 19 nt, Artificial Sequence
  Synthetic
uccuuuguacauuuuccua

SEQ ID NO: 21411 - RNA, 20 nt, Artificial Sequence
  Synthetic
auccuuuguacauuuuccua

SEQ ID NO: 21412 - RNA, 21 nt, Artificial Sequence
  Synthetic
aauccuuuguacauuuuccua

SEQ ID NO: 21413 - RNA, 22 nt, Artificial Sequence
  Synthetic
caauccuuuguacauuuuccua

SEQ ID NO: 21414 - RNA, 23 nt, Artificial Sequence
  Synthetic
ucaauccuuuguacauuuuccua

SEQ ID NO: 21415 - RNA, 24 nt, Artificial Sequence
  Synthetic
uucaauccuuuguacauuuuccua

SEQ ID NO: 21416 - RNA, 18 nt, Artificial Sequence
  Synthetic
agauaaaauuauaaauua

SEQ ID NO: 21417 - RNA, 19 nt, Artificial Sequence
  Synthetic
aagauaaaauuauaaauua

SEQ ID NO: 21418 - RNA, 20 nt, Artificial Sequence
  Synthetic
aaagauaaaauuauaaauua

SEQ ID NO: 21419 - RNA, 21 nt, Artificial Sequence
  Synthetic
uaaagauaaaauuauaaauua

SEQ ID NO: 21420 - RNA, 22 nt, Artificial Sequence
  Synthetic
auaaagauaaaauuauaaauua

SEQ ID NO: 21421 - RNA, 23 nt, Artificial Sequence
  Synthetic
aauaaagauaaaauuauaaauua

SEQ ID NO: 21422 - RNA, 24 nt, Artificial Sequence
  Synthetic
uaauaaagauaaaauuauaaauua

SEQ ID NO: 21423 - RNA, 18 nt, Artificial Sequence
  Synthetic
ucucagacuuuuauuuua

SEQ ID NO: 21424 - RNA, 19 nt, Artificial Sequence
  Synthetic
uucucagacuuuuauuuua

SEQ ID NO: 21425 - RNA, 20 nt, Artificial Sequence
  Synthetic
cuucucagacuuuuauuuua

SEQ ID NO: 21426 - RNA, 21 nt, Artificial Sequence
  Synthetic
ucuucucagacuuuuauuuua

SEQ ID NO: 21427 - RNA, 23 nt, Artificial Sequence
  Synthetic
ugucuucucagacuuuuauuuua

SEQ ID NO: 21428 - RNA, 24 nt, Artificial Sequence
  Synthetic
uugucuucucagacuuuuauuuua

SEQ ID NO: 21429 - RNA, 19 nt, Artificial Sequence
  Synthetic
aguuuccaaauuuuuuuua

SEQ ID NO: 21430 - RNA, 20 nt, Artificial Sequence
  Synthetic
aaguuuccaaauuuuuuuua

SEQ ID NO: 21431 - RNA, 21 nt, Artificial Sequence
  Synthetic
caaguuuccaaauuuuuuuua

SEQ ID NO: 21432 - RNA, 22 nt, Artificial Sequence
  Synthetic
acaaguuuccaaauuuuuuuua

SEQ ID NO: 21433 - RNA, 24 nt, Artificial Sequence
  Synthetic
agacaaguuuccaaauuuuuuuua

SEQ ID NO: 21434 - RNA, 19 nt, Artificial Sequence
  Synthetic
uguguggcuuauaaacaac

SEQ ID NO: 21435 - RNA, 21 nt, Artificial Sequence
  Synthetic
acuguguggcuuauaaacaac

SEQ ID NO: 21436 - RNA, 22 nt, Artificial Sequence
  Synthetic
aacuguguggcuuauaaacaac

SEQ ID NO: 21437 - RNA, 24 nt, Artificial Sequence
  Synthetic
ugaacuguguggcuuauaaacaac

SEQ ID NO: 21438 - RNA, 24 nt, Artificial Sequence
  Synthetic
ugggaagauacuaaaaaaaguuac

SEQ ID NO: 21439 - RNA, 22 nt, Artificial Sequence
  Synthetic
agcggaaaggucaauugagccc

SEQ ID NO: 21440 - RNA, 23 nt, Artificial Sequence
  Synthetic
aagcggaaaggucaauugagccc

SEQ ID NO: 21441 - RNA, 18 nt, Artificial Sequence
  Synthetic
uacuuggaagacucuucc

SEQ ID NO: 21442 - RNA, 19 nt, Artificial Sequence
  Synthetic
cuacuuggaagacucuucc

SEQ ID NO: 21443 - RNA, 21 nt, Artificial Sequence
  Synthetic
ugcuacuuggaagacucuucc

SEQ ID NO: 21444 - RNA, 22 nt, Artificial Sequence
  Synthetic
cugcuacuuggaagacucuucc

SEQ ID NO: 21445 - RNA, 23 nt, Artificial Sequence
  Synthetic
ccugcuacuuggaagacucuucc

SEQ ID NO: 21446 - RNA, 24 nt, Artificial Sequence
  Synthetic
accugcuacuuggaagacucuucc

SEQ ID NO: 21447 - RNA, 18 nt, Artificial Sequence
  Synthetic
acaccacugaaguucagc

SEQ ID NO: 21448 - RNA, 19 nt, Artificial Sequence
  Synthetic
cacaccacugaaguucagc

SEQ ID NO: 21449 - RNA, 20 nt, Artificial Sequence
  Synthetic
ucacaccacugaaguucagc

SEQ ID NO: 21450 - RNA, 21 nt, Artificial Sequence
  Synthetic
aucacaccacugaaguucagc

SEQ ID NO: 21451 - RNA, 23 nt, Artificial Sequence
  Synthetic
ugaucacaccacugaaguucagc

SEQ ID NO: 21452 - RNA, 24 nt, Artificial Sequence
  Synthetic
augaucacaccacugaaguucagc

SEQ ID NO: 21453 - RNA, 20 nt, Artificial Sequence
  Synthetic
cggaguuucacuguguuagc

SEQ ID NO: 21454 - RNA, 21 nt, Artificial Sequence
  Synthetic
acggaguuucacuguguuagc

SEQ ID NO: 21455 - RNA, 23 nt, Artificial Sequence
  Synthetic
agacggaguuucacuguguuagc

SEQ ID NO: 21456 - RNA, 18 nt, Artificial Sequence
  Synthetic
ucacucugucacccaggc

SEQ ID NO: 21457 - RNA, 19 nt, Artificial Sequence
  Synthetic
cucacucugucacccaggc

SEQ ID NO: 21458 - RNA, 20 nt, Artificial Sequence
  Synthetic
ucucacucugucacccaggc

SEQ ID NO: 21459 - RNA, 22 nt, Artificial Sequence
  Synthetic
agucucacucugucacccaggc

SEQ ID NO: 21460 - RNA, 24 nt, Artificial Sequence
  Synthetic
agagucucacucugucacccaggc

SEQ ID NO: 21461 - RNA, 21 nt, Artificial Sequence
  Synthetic
uuuugagccuaucaccuaggc

SEQ ID NO: 21462 - RNA, 22 nt, Artificial Sequence
  Synthetic
uuuuugagccuaucaccuaggc

SEQ ID NO: 21463 - RNA, 23 nt, Artificial Sequence
  Synthetic
uuuuuugagccuaucaccuaggc

SEQ ID NO: 21464 - RNA, 24 nt, Artificial Sequence
  Synthetic
uuuuuuugagccuaucaccuaggc

SEQ ID NO: 21465 - RNA, 18 nt, Artificial Sequence
  Synthetic
cucugccuccaaaagugc

SEQ ID NO: 21466 - RNA, 19 nt, Artificial Sequence
  Synthetic
ccucugccuccaaaagugc

SEQ ID NO: 21467 - RNA, 21 nt, Artificial Sequence
  Synthetic
ugccucugccuccaaaagugc

SEQ ID NO: 21468 - RNA, 22 nt, Artificial Sequence
  Synthetic
cugccucugccuccaaaagugc

SEQ ID NO: 21469 - RNA, 23 nt, Artificial Sequence
  Synthetic
ccugccucugccuccaaaagugc

SEQ ID NO: 21470 - RNA, 24 nt, Artificial Sequence
  Synthetic
accugccucugccuccaaaagugc

SEQ ID NO: 21471 - RNA, 20 nt, Artificial Sequence
  Synthetic
cauucuccugccucagccuc

SEQ ID NO: 21472 - RNA, 21 nt, Artificial Sequence
  Synthetic
ccauucuccugccucagccuc

SEQ ID NO: 21473 - RNA, 23 nt, Artificial Sequence
  Synthetic
cgccauucuccugccucagccuc

SEQ ID NO: 21474 - RNA, 24 nt, Artificial Sequence
  Synthetic
acgccauucuccugccucagccuc

SEQ ID NO: 21475 - RNA, 18 nt, Artificial Sequence
  Synthetic
cacugcaaguucugccuc

SEQ ID NO: 21476 - RNA, 19 nt, Artificial Sequence
  Synthetic
ucacugcaaguucugccuc

SEQ ID NO: 21477 - RNA, 20 nt, Artificial Sequence
  Synthetic
cucacugcaaguucugccuc

SEQ ID NO: 21478 - RNA, 23 nt, Artificial Sequence
  Synthetic
cggcucacugcaaguucugccuc

SEQ ID NO: 21479 - RNA, 24 nt, Artificial Sequence
  Synthetic
ucggcucacugcaaguucugccuc

SEQ ID NO: 21480 - RNA, 18 nt, Artificial Sequence
  Synthetic
uauugcuuucauuaaguc

SEQ ID NO: 21481 - RNA, 19 nt, Artificial Sequence
  Synthetic
cuauugcuuucauuaaguc

SEQ ID NO: 21482 - RNA, 20 nt, Artificial Sequence
  Synthetic
acuauugcuuucauuaaguc

SEQ ID NO: 21483 - RNA, 18 nt, Artificial Sequence
  Synthetic
cuuccuucaaagcauguc

SEQ ID NO: 21484 - RNA, 19 nt, Artificial Sequence
  Synthetic
ucuuccuucaaagcauguc

SEQ ID NO: 21485 - RNA, 20 nt, Artificial Sequence
  Synthetic
aucuuccuucaaagcauguc

SEQ ID NO: 21486 - RNA, 23 nt, Artificial Sequence
  Synthetic
uggaucuuccuucaaagcauguc

SEQ ID NO: 21487 - RNA, 24 nt, Artificial Sequence
  Synthetic
uuggaucuuccuucaaagcauguc

SEQ ID NO: 21488 - RNA, 21 nt, Artificial Sequence
  Synthetic
ugauauuuuucauuaugauuc

SEQ ID NO: 21489 - RNA, 24 nt, Artificial Sequence
  Synthetic
uggugauauuuuucauuaugauuc

SEQ ID NO: 21490 - RNA, 18 nt, Artificial Sequence
  Synthetic
cuugggaggcugaggcag

SEQ ID NO: 21491 - RNA, 19 nt, Artificial Sequence
  Synthetic
acuugggaggcugaggcag

SEQ ID NO: 21492 - RNA, 20 nt, Artificial Sequence
  Synthetic
uacuugggaggcugaggcag

SEQ ID NO: 21493 - RNA, 21 nt, Artificial Sequence
  Synthetic
cuacuugggaggcugaggcag

SEQ ID NO: 21494 - RNA, 23 nt, Artificial Sequence
  Synthetic
agcuacuugggaggcugaggcag

SEQ ID NO: 21495 - RNA, 24 nt, Artificial Sequence
  Synthetic
cagcuacuugggaggcugaggcag

SEQ ID NO: 21496 - RNA, 18 nt, Artificial Sequence
  Synthetic
cuugggagggugaggcag

SEQ ID NO: 21497 - RNA, 19 nt, Artificial Sequence
  Synthetic
acuugggagggugaggcag

SEQ ID NO: 21498 - RNA, 20 nt, Artificial Sequence
  Synthetic
uacuugggagggugaggcag

SEQ ID NO: 21499 - RNA, 21 nt, Artificial Sequence
  Synthetic
cuacuugggagggugaggcag

SEQ ID NO: 21500 - RNA, 23 nt, Artificial Sequence
  Synthetic
agcuacuugggagggugaggcag

SEQ ID NO: 21501 - RNA, 24 nt, Artificial Sequence
  Synthetic
cagcuacuugggagggugaggcag

SEQ ID NO: 21502 - RNA, 18 nt, Artificial Sequence
  Synthetic
uaaaaauacaaaaauuag

SEQ ID NO: 21503 - RNA, 19 nt, Artificial Sequence
  Synthetic
cuaaaaauacaaaaauuag

SEQ ID NO: 21504 - RNA, 20 nt, Artificial Sequence
  Synthetic
acuaaaaauacaaaaauuag

SEQ ID NO: 21505 - RNA, 21 nt, Artificial Sequence
  Synthetic
uacuaaaaauacaaaaauuag

SEQ ID NO: 21506 - RNA, 22 nt, Artificial Sequence
  Synthetic
cuacuaaaaauacaaaaauuag

SEQ ID NO: 21507 - RNA, 23 nt, Artificial Sequence
  Synthetic
ucuacuaaaaauacaaaaauuag

SEQ ID NO: 21508 - RNA, 24 nt, Artificial Sequence
  Synthetic
cucuacuaaaaauacaaaaauuag

SEQ ID NO: 21509 - RNA, 18 nt, Artificial Sequence
  Synthetic
ugaucuugaagacauacg

SEQ ID NO: 21510 - RNA, 19 nt, Artificial Sequence
  Synthetic
uugaucuugaagacauacg

SEQ ID NO: 21511 - RNA, 20 nt, Artificial Sequence
  Synthetic
auugaucuugaagacauacg

SEQ ID NO: 21512 - RNA, 18 nt, Artificial Sequence
  Synthetic
uuguguuuuuuguagagg

SEQ ID NO: 21513 - RNA, 19 nt, Artificial Sequence
  Synthetic
uuuguguuuuuuguagagg

SEQ ID NO: 21514 - RNA, 21 nt, Artificial Sequence
  Synthetic
uguuuguguuuuuuguagagg

SEQ ID NO: 21515 - RNA, 22 nt, Artificial Sequence
  Synthetic
uuguuuguguuuuuuguagagg

SEQ ID NO: 21516 - RNA, 23 nt, Artificial Sequence
  Synthetic
uuuguuuguguuuuuuguagagg

SEQ ID NO: 21517 - RNA, 24 nt, Artificial Sequence
  Synthetic
uuuuguuuguguuuuuuguagagg

SEQ ID NO: 21518 - RNA, 18 nt, Artificial Sequence
  Synthetic
uuugggaggccgaggcgg

SEQ ID NO: 21519 - RNA, 19 nt, Artificial Sequence
  Synthetic
cuuugggaggccgaggcgg

SEQ ID NO: 21520 - RNA, 20 nt, Artificial Sequence
  Synthetic
acuuugggaggccgaggcgg

SEQ ID NO: 21521 - RNA, 21 nt, Artificial Sequence
  Synthetic
cacuuugggaggccgaggcgg

SEQ ID NO: 21522 - RNA, 23 nt, Artificial Sequence
  Synthetic
agcacuuugggaggccgaggcgg

SEQ ID NO: 21523 - RNA, 24 nt, Artificial Sequence
  Synthetic
cagcacuuugggaggccgaggcgg

SEQ ID NO: 21524 - RNA, 18 nt, Artificial Sequence
  Synthetic
aaaaauuaaaacuaaugg

SEQ ID NO: 21525 - RNA, 19 nt, Artificial Sequence
  Synthetic
caaaaauuaaaacuaaugg

SEQ ID NO: 21526 - RNA, 20 nt, Artificial Sequence
  Synthetic
acaaaaauuaaaacuaaugg

SEQ ID NO: 21527 - RNA, 21 nt, Artificial Sequence
  Synthetic
aacaaaaauuaaaacuaaugg

SEQ ID NO: 21528 - RNA, 23 nt, Artificial Sequence
  Synthetic
ugaacaaaaauuaaaacuaaugg

SEQ ID NO: 21529 - RNA, 21 nt, Artificial Sequence
  Synthetic
cuuuaacaaaccuuuuauugg

SEQ ID NO: 21530 - RNA, 22 nt, Artificial Sequence
  Synthetic
ucuuuaacaaaccuuuuauugg

SEQ ID NO: 21531 - RNA, 23 nt, Artificial Sequence
  Synthetic
uucuuuaacaaaccuuuuauugg

SEQ ID NO: 21532 - RNA, 24 nt, Artificial Sequence
  Synthetic
auucuuuaacaaaccuuuuauugg

SEQ ID NO: 21533 - RNA, 19 nt, Artificial Sequence
  Synthetic
uguagucccagcuacuugg

SEQ ID NO: 21534 - RNA, 20 nt, Artificial Sequence
  Synthetic
cuguagucccagcuacuugg

SEQ ID NO: 21535 - RNA, 21 nt, Artificial Sequence
  Synthetic
ccuguagucccagcuacuugg

SEQ ID NO: 21536 - RNA, 23 nt, Artificial Sequence
  Synthetic
ugccuguagucccagcuacuugg

SEQ ID NO: 21537 - RNA, 21 nt, Artificial Sequence
  Synthetic
aaaggaaaugggguauaagug

SEQ ID NO: 21538 - RNA, 22 nt, Artificial Sequence
  Synthetic
caaaggaaaugggguauaagug

SEQ ID NO: 21539 - RNA, 23 nt, Artificial Sequence
  Synthetic
acaaaggaaaugggguauaagug

SEQ ID NO: 21540 - RNA, 24 nt, Artificial Sequence
  Synthetic
aacaaaggaaaugggguauaagug

SEQ ID NO: 21541 - RNA, 18 nt, Artificial Sequence
  Synthetic
acuacuaauagccuauug

SEQ ID NO: 21542 - RNA, 19 nt, Artificial Sequence
  Synthetic
aacuacuaauagccuauug

SEQ ID NO: 21543 - RNA, 20 nt, Artificial Sequence
  Synthetic
uaacuacuaauagccuauug

SEQ ID NO: 21544 - RNA, 21 nt, Artificial Sequence
  Synthetic
uuaacuacuaauagccuauug

SEQ ID NO: 21545 - RNA, 22 nt, Artificial Sequence
  Synthetic
cuuaacuacuaauagccuauug

SEQ ID NO: 21546 - RNA, 23 nt, Artificial Sequence
  Synthetic
acuuaacuacuaauagccuauug

SEQ ID NO: 21547 - RNA, 24 nt, Artificial Sequence
  Synthetic
aacuuaacuacuaauagccuauug

SEQ ID NO: 21548 - RNA, 18 nt, Artificial Sequence
  Synthetic
uaaaacuaauggcagaau

SEQ ID NO: 21549 - RNA, 19 nt, Artificial Sequence
  Synthetic
uuaaaacuaauggcagaau

SEQ ID NO: 21550 - RNA, 20 nt, Artificial Sequence
  Synthetic
auuaaaacuaauggcagaau

SEQ ID NO: 21551 - RNA, 21 nt, Artificial Sequence
  Synthetic
aauuaaaacuaauggcagaau

SEQ ID NO: 21552 - RNA, 22 nt, Artificial Sequence
  Synthetic
aaauuaaaacuaauggcagaau

SEQ ID NO: 21553 - RNA, 23 nt, Artificial Sequence
  Synthetic
aaaauuaaaacuaauggcagaau

SEQ ID NO: 21554 - RNA, 24 nt, Artificial Sequence
  Synthetic
aaaaauuaaaacuaauggcagaau

SEQ ID NO: 21555 - RNA, 18 nt, Artificial Sequence
  Synthetic
uaccaucaccuugggaau

SEQ ID NO: 21556 - RNA, 19 nt, Artificial Sequence
  Synthetic
auaccaucaccuugggaau

SEQ ID NO: 21557 - RNA, 20 nt, Artificial Sequence
  Synthetic
aauaccaucaccuugggaau

SEQ ID NO: 21558 - RNA, 21 nt, Artificial Sequence
  Synthetic
caauaccaucaccuugggaau

SEQ ID NO: 21559 - RNA, 23 nt, Artificial Sequence
  Synthetic
ugcaauaccaucaccuugggaau

SEQ ID NO: 21560 - RNA, 24 nt, Artificial Sequence
  Synthetic
cugcaauaccaucaccuugggaau

SEQ ID NO: 21561 - RNA, 21 nt, Artificial Sequence
  Synthetic
ugggaauuaggauuucaacau

SEQ ID NO: 21562 - RNA, 22 nt, Artificial Sequence
  Synthetic
uugggaauuaggauuucaacau

SEQ ID NO: 21563 - RNA, 23 nt, Artificial Sequence
  Synthetic
cuugggaauuaggauuucaacau

SEQ ID NO: 21564 - RNA, 24 nt, Artificial Sequence
  Synthetic
ccuugggaauuaggauuucaacau

SEQ ID NO: 21565 - RNA, 18 nt, Artificial Sequence
  Synthetic
aucaaggugccagcagau

SEQ ID NO: 21566 - RNA, 20 nt, Artificial Sequence
  Synthetic
agaucaaggugccagcagau

SEQ ID NO: 21567 - RNA, 21 nt, Artificial Sequence
  Synthetic
aagaucaaggugccagcagau

SEQ ID NO: 21568 - RNA, 22 nt, Artificial Sequence
  Synthetic
caagaucaaggugccagcagau

SEQ ID NO: 21569 - RNA, 23 nt, Artificial Sequence
  Synthetic
ccaagaucaaggugccagcagau

SEQ ID NO: 21570 - RNA, 24 nt, Artificial Sequence
  Synthetic
uccaagaucaaggugccagcagau

SEQ ID NO: 21571 - RNA, 18 nt, Artificial Sequence
  Synthetic
ugauaguugcacaacuau

SEQ ID NO: 21572 - RNA, 21 nt, Artificial Sequence
  Synthetic
aggugauaguugcacaacuau

SEQ ID NO: 21573 - RNA, 24 nt, Artificial Sequence
  Synthetic
aggaggugauaguugcacaacuau

SEQ ID NO: 21574 - RNA, 18 nt, Artificial Sequence
  Synthetic
uuuacauuucucuuuacu

SEQ ID NO: 21575 - RNA, 19 nt, Artificial Sequence
  Synthetic
auuuacauuucucuuuacu

SEQ ID NO: 21576 - RNA, 20 nt, Artificial Sequence
  Synthetic
uauuuacauuucucuuuacu

SEQ ID NO: 21577 - RNA, 21 nt, Artificial Sequence
  Synthetic
uuauuuacauuucucuuuacu

SEQ ID NO: 21578 - RNA, 22 nt, Artificial Sequence
  Synthetic
uuuauuuacauuucucuuuacu

SEQ ID NO: 21579 - RNA, 24 nt, Artificial Sequence
  Synthetic
uguuuauuuacauuucucuuuacu

SEQ ID NO: 21580 - RNA, 18 nt, Artificial Sequence
  Synthetic
aaauguuaaauuuucccu

SEQ ID NO: 21581 - RNA, 19 nt, Artificial Sequence
  Synthetic
aaaauguuaaauuuucccu

SEQ ID NO: 21582 - RNA, 21 nt, Artificial Sequence
  Synthetic
aguuacucaguccagaaagcu

SEQ ID NO: 21583 - RNA, 22 nt, Artificial Sequence
  Synthetic
caguuacucaguccagaaagcu

SEQ ID NO: 21584 - RNA, 23 nt, Artificial Sequence
  Synthetic
ccaguuacucaguccagaaagcu

SEQ ID NO: 21585 - RNA, 24 nt, Artificial Sequence
  Synthetic
uccaguuacucaguccagaaagcu

SEQ ID NO: 21586 - RNA, 21 nt, Artificial Sequence
  Synthetic
aauuuaauugccaguaagucu

SEQ ID NO: 21587 - RNA, 22 nt, Artificial Sequence
  Synthetic
aaauuuaauugccaguaagucu

SEQ ID NO: 21588 - RNA, 24 nt, Artificial Sequence
  Synthetic
ugaaauuuaauugccaguaagucu

SEQ ID NO: 21589 - RNA, 21 nt, Artificial Sequence
  Synthetic
uaugccagguuaaguuguucu

SEQ ID NO: 21590 - RNA, 22 nt, Artificial Sequence
  Synthetic
auaugccagguuaaguuguucu

SEQ ID NO: 21591 - RNA, 23 nt, Artificial Sequence
  Synthetic
aauaugccagguuaaguuguucu

SEQ ID NO: 21592 - RNA, 24 nt, Artificial Sequence
  Synthetic
aaauaugccagguuaaguuguucu

SEQ ID NO: 21593 - RNA, 18 nt, Artificial Sequence
  Synthetic
cacauggcagaaaggggu

SEQ ID NO: 21594 - RNA, 19 nt, Artificial Sequence
  Synthetic
ucacauggcagaaaggggu

SEQ ID NO: 21595 - RNA, 20 nt, Artificial Sequence
  Synthetic
cucacauggcagaaaggggu

SEQ ID NO: 21596 - RNA, 21 nt, Artificial Sequence
  Synthetic
ucucacauggcagaaaggggu

SEQ ID NO: 21597 - RNA, 22 nt, Artificial Sequence
  Synthetic
uucucacauggcagaaaggggu

SEQ ID NO: 21598 - RNA, 24 nt, Artificial Sequence
  Synthetic
uguucucacauggcagaaaggggu

SEQ ID NO: 21599 - RNA, 18 nt, Artificial Sequence
  Synthetic
ucacuaguggcacuuugu

SEQ ID NO: 21600 - RNA, 19 nt, Artificial Sequence
  Synthetic
aucacuaguggcacuuugu

SEQ ID NO: 21601 - RNA, 20 nt, Artificial Sequence
  Synthetic
caucacuaguggcacuuugu

SEQ ID NO: 21602 - RNA, 22 nt, Artificial Sequence
  Synthetic
ugcaucacuaguggcacuuugu

SEQ ID NO: 21603 - RNA, 24 nt, Artificial Sequence
  Synthetic
cgugcaucacuaguggcacuuugu

SEQ ID NO: 21604 - RNA, 18 nt, Artificial Sequence
  Synthetic
cugcaauaccaucaccuu

SEQ ID NO: 21605 - RNA, 19 nt, Artificial Sequence
  Synthetic
ccugcaauaccaucaccuu

SEQ ID NO: 21606 - RNA, 21 nt, Artificial Sequence
  Synthetic
acccugcaauaccaucaccuu

SEQ ID NO: 21607 - RNA, 22 nt, Artificial Sequence
  Synthetic
cacccugcaauaccaucaccuu

SEQ ID NO: 21608 - RNA, 23 nt, Artificial Sequence
  Synthetic
ccacccugcaauaccaucaccuu

SEQ ID NO: 21609 - RNA, 24 nt, Artificial Sequence
  Synthetic
cccacccugcaauaccaucaccuu

SEQ ID NO: 21610 - RNA, 18 nt, Artificial Sequence
  Synthetic
auaaaagaaaugcaaguu

SEQ ID NO: 21611 - RNA, 19 nt, Artificial Sequence
  Synthetic
aauaaaagaaaugcaaguu

SEQ ID NO: 21612 - RNA, 20 nt, Artificial Sequence
  Synthetic
uaauaaaagaaaugcaaguu

SEQ ID NO: 21613 - RNA, 21 nt, Artificial Sequence
  Synthetic
auaauaaaagaaaugcaaguu

SEQ ID NO: 21614 - RNA, 22 nt, Artificial Sequence
  Synthetic
uauaauaaaagaaaugcaaguu

SEQ ID NO: 21615 - RNA, 23 nt, Artificial Sequence
  Synthetic
uuauaauaaaagaaaugcaaguu

SEQ ID NO: 21616 - RNA, 24 nt, Artificial Sequence
  Synthetic
cuuauaauaaaagaaaugcaaguu

SEQ ID NO: 21617 - RNA, 21 nt, Artificial Sequence
  Synthetic
cccuuuaucaacaugaagguu

SEQ ID NO: 21618 - RNA, 22 nt, Artificial Sequence
  Synthetic
acccuuuaucaacaugaagguu

SEQ ID NO: 21619 - RNA, 24 nt, Artificial Sequence
  Synthetic
ugacccuuuaucaacaugaagguu

SEQ ID NO: 21620 - RNA, 18 nt, Artificial Sequence
  Synthetic
auagauuuaaucuuauuu

SEQ ID NO: 21621 - RNA, 19 nt, Artificial Sequence
  Synthetic
uauagauuuaaucuuauuu

SEQ ID NO: 21622 - RNA, 20 nt, Artificial Sequence
  Synthetic
auauagauuuaaucuuauuu

SEQ ID NO: 21623 - RNA, 21 nt, Artificial Sequence
  Synthetic
aauauagauuuaaucuuauuu

SEQ ID NO: 21624 - RNA, 22 nt, Artificial Sequence
  Synthetic
aaauauagauuuaaucuuauuu

SEQ ID NO: 21625 - RNA, 18 nt, Artificial Sequence
  Synthetic
uucuaggcuagacaguuu

SEQ ID NO: 21626 - RNA, 19 nt, Artificial Sequence
  Synthetic
uuucuaggcuagacaguuu

SEQ ID NO: 21627 - RNA, 20 nt, Artificial Sequence
  Synthetic
auuucuaggcuagacaguuu

SEQ ID NO: 21628 - RNA, 21 nt, Artificial Sequence
  Synthetic
uauuucuaggcuagacaguuu

SEQ ID NO: 21629 - RNA, 24 nt, Artificial Sequence
  Synthetic
cgguauuucuaggcuagacaguuu

SEQ ID NO: 21630 - RNA, 18 nt, Artificial Sequence
  Synthetic
uucaagccuguauuguuu

SEQ ID NO: 21631 - RNA, 20 nt, Artificial Sequence
  Synthetic
aguucaagccuguauuguuu

SEQ ID NO: 21632 - RNA, 21 nt, Artificial Sequence
  Synthetic
caguucaagccuguauuguuu

SEQ ID NO: 21633 - RNA, 23 nt, Artificial Sequence
  Synthetic
ugcaguucaagccuguauuguuu

SEQ ID NO: 21634 - RNA, 24 nt, Artificial Sequence
  Synthetic
augcaguucaagccuguauuguuu

SEQ ID NO: 21635 - RNA, 21 nt, Artificial Sequence
  Synthetic
uauuuaaacacuucugagaaa

SEQ ID NO: 21636 - RNA, 22 nt, Artificial Sequence
  Synthetic
auauuuaaacacuucugagaaa

SEQ ID NO: 21637 - RNA, 23 nt, Artificial Sequence
  Synthetic
aauauuuaaacacuucugagaaa

SEQ ID NO: 21638 - RNA, 21 nt, Artificial Sequence
  Synthetic
augcuuugaaggaagauccaa

SEQ ID NO: 21639 - RNA, 22 nt, Artificial Sequence
  Synthetic
caugcuuugaaggaagauccaa

SEQ ID NO: 21640 - RNA, 23 nt, Artificial Sequence
  Synthetic
acaugcuuugaaggaagauccaa

SEQ ID NO: 21641 - RNA, 19 nt, Artificial Sequence
  Synthetic
agaaccauauuuugaagaa

SEQ ID NO: 21642 - RNA, 18 nt, Artificial Sequence
  Synthetic
uauauuauagaaauuuaa

SEQ ID NO: 21643 - RNA, 21 nt, Artificial Sequence
  Synthetic
agguauauuauagaaauuuaa

SEQ ID NO: 21644 - RNA, 22 nt, Artificial Sequence
  Synthetic
cagguauauuauagaaauuuaa

SEQ ID NO: 21645 - RNA, 23 nt, Artificial Sequence
  Synthetic
acagguauauuauagaaauuuaa

SEQ ID NO: 21646 - RNA, 18 nt, Artificial Sequence
  Synthetic
uggauuuuugacuauaca

SEQ ID NO: 21647 - RNA, 20 nt, Artificial Sequence
  Synthetic
cguggauuuuugacuauaca

SEQ ID NO: 21648 - RNA, 21 nt, Artificial Sequence
  Synthetic
acguggauuuuugacuauaca

SEQ ID NO: 21649 - RNA, 22 nt, Artificial Sequence
  Synthetic
uacguggauuuuugacuauaca

SEQ ID NO: 21650 - RNA, 23 nt, Artificial Sequence
  Synthetic
auacguggauuuuugacuauaca

SEQ ID NO: 21651 - RNA, 24 nt, Artificial Sequence
  Synthetic
uauacguggauuuuugacuauaca

SEQ ID NO: 21652 - RNA, 18 nt, Artificial Sequence
  Synthetic
ucauuaggaaaauguaca

SEQ ID NO: 21653 - RNA, 19 nt, Artificial Sequence
  Synthetic
cucauuaggaaaauguaca

SEQ ID NO: 21654 - RNA, 20 nt, Artificial Sequence
  Synthetic
acucauuaggaaaauguaca

SEQ ID NO: 21655 - RNA, 18 nt, Artificial Sequence
  Synthetic
aggucacugaggcuggca

SEQ ID NO: 21656 - RNA, 21 nt, Artificial Sequence
  Synthetic
aggaggucacugaggcuggca

SEQ ID NO: 21657 - RNA, 22 nt, Artificial Sequence
  Synthetic
aaggaggucacugaggcuggca

SEQ ID NO: 21658 - RNA, 23 nt, Artificial Sequence
  Synthetic
uaaggaggucacugaggcuggca

SEQ ID NO: 21659 - RNA, 22 nt, Artificial Sequence
  Synthetic
agauaugaaguuaaaaacauca

SEQ ID NO: 21660 - RNA, 21 nt, Artificial Sequence
  Synthetic
uuaguauagaauuuugcauca

SEQ ID NO: 21661 - RNA, 22 nt, Artificial Sequence
  Synthetic
auuaguauagaauuuugcauca

SEQ ID NO: 21662 - RNA, 23 nt, Artificial Sequence
  Synthetic
uauuaguauagaauuuugcauca

SEQ ID NO: 21663 - RNA, 24 nt, Artificial Sequence
  Synthetic
auauuaguauagaauuuugcauca

SEQ ID NO: 21664 - RNA, 21 nt, Artificial Sequence
  Synthetic
uaaagagccuuuucuuuuuca

SEQ ID NO: 21665 - RNA, 22 nt, Artificial Sequence
  Synthetic
auaaagagccuuuucuuuuuca

SEQ ID NO: 21666 - RNA, 23 nt, Artificial Sequence
  Synthetic
uauaaagagccuuuucuuuuuca

SEQ ID NO: 21667 - RNA, 24 nt, Artificial Sequence
  Synthetic
uuauaaagagccuuuucuuuuuca

SEQ ID NO: 21668 - RNA, 21 nt, Artificial Sequence
  Synthetic
agaucuagcuaaaauauaaga

SEQ ID NO: 21669 - RNA, 22 nt, Artificial Sequence
  Synthetic
aagaucuagcuaaaauauaaga

SEQ ID NO: 21670 - RNA, 23 nt, Artificial Sequence
  Synthetic
aaagaucuagcuaaaauauaaga

SEQ ID NO: 21671 - RNA, 24 nt, Artificial Sequence
  Synthetic
aaaagaucuagcuaaaauauaaga

SEQ ID NO: 21672 - RNA, 22 nt, Artificial Sequence
  Synthetic
auuuuuguauuuuuaguagaga

SEQ ID NO: 21673 - RNA, 23 nt, Artificial Sequence
  Synthetic
aauuuuuguauuuuuaguagaga

SEQ ID NO: 21674 - RNA, 24 nt, Artificial Sequence
  Synthetic
uaauuuuuguauuuuuaguagaga

SEQ ID NO: 21675 - RNA, 18 nt, Artificial Sequence
  Synthetic
uuacuauuauuuuugaga

SEQ ID NO: 21676 - RNA, 19 nt, Artificial Sequence
  Synthetic
auuacuauuauuuuugaga

SEQ ID NO: 21677 - RNA, 20 nt, Artificial Sequence
  Synthetic
uauuacuauuauuuuugaga

SEQ ID NO: 21678 - RNA, 21 nt, Artificial Sequence
  Synthetic
auauuacuauuauuuuugaga

SEQ ID NO: 21679 - RNA, 22 nt, Artificial Sequence
  Synthetic
aauauuacuauuauuuuugaga

SEQ ID NO: 21680 - RNA, 23 nt, Artificial Sequence
  Synthetic
uaauauuacuauuauuuuugaga

SEQ ID NO: 21681 - RNA, 24 nt, Artificial Sequence
  Synthetic
uuaauauuacuauuauuuuugaga

SEQ ID NO: 21682 - RNA, 18 nt, Artificial Sequence
  Synthetic
uuuuuuuuuuuuuugaga

SEQ ID NO: 21683 - RNA, 19 nt, Artificial Sequence
  Synthetic
uuuuuuuuuuuuuuugaga

SEQ ID NO: 21684 - RNA, 21 nt, Artificial Sequence
  Synthetic
uuuuuuuuuuuuuuuuugaga

SEQ ID NO: 21685 - RNA, 22 nt, Artificial Sequence
  Synthetic
uuuuuuuuuuuuuuuuuugaga

SEQ ID NO: 21686 - RNA, 23 nt, Artificial Sequence
  Synthetic
uuuuuuuuuuuuuuuuuuugaga

SEQ ID NO: 21687 - RNA, 24 nt, Artificial Sequence
  Synthetic
uuuuuuuuuuuuuuuuuuuugaga

SEQ ID NO: 21688 - RNA, 19 nt, Artificial Sequence
  Synthetic
ugaccagaaugaaauuaga

SEQ ID NO: 21689 - RNA, 20 nt, Artificial Sequence
  Synthetic
uugaccagaaugaaauuaga

SEQ ID NO: 21690 - RNA, 21 nt, Artificial Sequence
  Synthetic
auuaggaaaauguacaaagga

SEQ ID NO: 21691 - RNA, 22 nt, Artificial Sequence
  Synthetic
cauuaggaaaauguacaaagga

SEQ ID NO: 21692 - RNA, 23 nt, Artificial Sequence
  Synthetic
ucauuaggaaaauguacaaagga

SEQ ID NO: 21693 - RNA, 24 nt, Artificial Sequence
  Synthetic
cucauuaggaaaauguacaaagga

SEQ ID NO: 21694 - RNA, 22 nt, Artificial Sequence
  Synthetic
agaugauuccaagcuuucugga

SEQ ID NO: 21695 - RNA, 23 nt, Artificial Sequence
  Synthetic
aagaugauuccaagcuuucugga

SEQ ID NO: 21696 - RNA, 24 nt, Artificial Sequence
  Synthetic
aaagaugauuccaagcuuucugga

SEQ ID NO: 21697 - RNA, 18 nt, Artificial Sequence
  Synthetic
auaaauuuaaagacauga

SEQ ID NO: 21698 - RNA, 19 nt, Artificial Sequence
  Synthetic
aauaaauuuaaagacauga

SEQ ID NO: 21699 - RNA, 20 nt, Artificial Sequence
  Synthetic
aaauaaauuuaaagacauga

SEQ ID NO: 21700 - RNA, 23 nt, Artificial Sequence
  Synthetic
aggaaauaaauuuaaagacauga

SEQ ID NO: 21701 - RNA, 18 nt, Artificial Sequence
  Synthetic
agaagacaaagcuaguga

SEQ ID NO: 21702 - RNA, 20 nt, Artificial Sequence
  Synthetic
ugagaagacaaagcuaguga

SEQ ID NO: 21703 - RNA, 21 nt, Artificial Sequence
  Synthetic
cugagaagacaaagcuaguga

SEQ ID NO: 21704 - RNA, 22 nt, Artificial Sequence
  Synthetic
ucugagaagacaaagcuaguga

SEQ ID NO: 21705 - RNA, 24 nt, Artificial Sequence
  Synthetic
agucugagaagacaaagcuaguga

SEQ ID NO: 21706 - RNA, 19 nt, Artificial Sequence
  Synthetic
ugcacucuagccuggguga

SEQ ID NO: 21707 - RNA, 20 nt, Artificial Sequence
  Synthetic
cugcacucuagccuggguga

SEQ ID NO: 21708 - RNA, 21 nt, Artificial Sequence
  Synthetic
acugcacucuagccuggguga

SEQ ID NO: 21709 - RNA, 22 nt, Artificial Sequence
  Synthetic
cacugcacucuagccuggguga

SEQ ID NO: 21710 - RNA, 23 nt, Artificial Sequence
  Synthetic
ccacugcacucuagccuggguga

SEQ ID NO: 21711 - RNA, 21 nt, Artificial Sequence
  Synthetic
ccccuaaccuucauguugaua

SEQ ID NO: 21712 - RNA, 22 nt, Artificial Sequence
  Synthetic
accccuaaccuucauguugaua

SEQ ID NO: 21713 - RNA, 23 nt, Artificial Sequence
  Synthetic
caccccuaaccuucauguugaua

SEQ ID NO: 21714 - RNA, 21 nt, Artificial Sequence
  Synthetic
aaaauacuuucuagaauuaua

SEQ ID NO: 21715 - RNA, 22 nt, Artificial Sequence
  Synthetic
caaaauacuuucuagaauuaua

SEQ ID NO: 21716 - RNA, 23 nt, Artificial Sequence
  Synthetic
ucaaaauacuuucuagaauuaua

SEQ ID NO: 21717 - RNA, 24 nt, Artificial Sequence
  Synthetic
uucaaaauacuuucuagaauuaua

SEQ ID NO: 21718 - RNA, 21 nt, Artificial Sequence
  Synthetic
cguuuuugcuugcuuuuuaua

SEQ ID NO: 21719 - RNA, 22 nt, Artificial Sequence
  Synthetic
acguuuuugcuugcuuuuuaua

SEQ ID NO: 21720 - RNA, 23 nt, Artificial Sequence
  Synthetic
cacguuuuugcuugcuuuuuaua

SEQ ID NO: 21721 - RNA, 24 nt, Artificial Sequence
  Synthetic
ucacguuuuugcuugcuuuuuaua

SEQ ID NO: 21722 - RNA, 21 nt, Artificial Sequence
  Synthetic
cuugcaggaggugagggauua

SEQ ID NO: 21723 - RNA, 22 nt, Artificial Sequence
  Synthetic
acuugcaggaggugagggauua

SEQ ID NO: 21724 - RNA, 24 nt, Artificial Sequence
  Synthetic
agacuugcaggaggugagggauua

SEQ ID NO: 21725 - RNA, 18 nt, Artificial Sequence
  Synthetic
ccaauaaaagguuuguua

SEQ ID NO: 21726 - RNA, 20 nt, Artificial Sequence
  Synthetic
agccaauaaaagguuuguua

SEQ ID NO: 21727 - RNA, 21 nt, Artificial Sequence
  Synthetic
uaaguuagcaauggucuaaac

SEQ ID NO: 21728 - RNA, 22 nt, Artificial Sequence
  Synthetic
auaaguuagcaauggucuaaac

SEQ ID NO: 21729 - RNA, 23 nt, Artificial Sequence
  Synthetic
aauaaguuagcaauggucuaaac

SEQ ID NO: 21730 - RNA, 24 nt, Artificial Sequence
  Synthetic
aaauaaguuagcaauggucuaaac

SEQ ID NO: 21731 - RNA, 18 nt, Artificial Sequence
  Synthetic
uaaacuuuguuuuucaac

SEQ ID NO: 21732 - RNA, 19 nt, Artificial Sequence
  Synthetic
uuaaacuuuguuuuucaac

SEQ ID NO: 21733 - RNA, 20 nt, Artificial Sequence
  Synthetic
uuuaaacuuuguuuuucaac

SEQ ID NO: 21734 - RNA, 21 nt, Artificial Sequence
  Synthetic
auuuaaacuuuguuuuucaac

SEQ ID NO: 21735 - RNA, 22 nt, Artificial Sequence
  Synthetic
uauuuaaacuuuguuuuucaac

SEQ ID NO: 21736 - RNA, 23 nt, Artificial Sequence
  Synthetic
auauuuaaacuuuguuuuucaac

SEQ ID NO: 21737 - RNA, 24 nt, Artificial Sequence
  Synthetic
cauauuuaaacuuuguuuuucaac

SEQ ID NO: 21738 - RNA, 18 nt, Artificial Sequence
  Synthetic
cauauauauauuuuuaac

SEQ ID NO: 21739 - RNA, 20 nt, Artificial Sequence
  Synthetic
ugcauauauauauuuuuaac

SEQ ID NO: 21740 - RNA, 21 nt, Artificial Sequence
  Synthetic
augcauauauauauuuuuaac

SEQ ID NO: 21741 - RNA, 22 nt, Artificial Sequence
  Synthetic
uaugcauauauauauuuuuaac

SEQ ID NO: 21742 - RNA, 23 nt, Artificial Sequence
  Synthetic
auaugcauauauauauuuuuaac

SEQ ID NO: 21743 - RNA, 24 nt, Artificial Sequence
  Synthetic
aauaugcauauauauauuuuuaac

SEQ ID NO: 21744 - RNA, 18 nt, Artificial Sequence
  Synthetic
uggagucaaaaauuauac

SEQ ID NO: 21745 - RNA, 20 nt, Artificial Sequence
  Synthetic
uguggagucaaaaauuauac

SEQ ID NO: 21746 - RNA, 21 nt, Artificial Sequence
  Synthetic
uuguggagucaaaaauuauac

SEQ ID NO: 21747 - RNA, 22 nt, Artificial Sequence
  Synthetic
uuuguggagucaaaaauuauac

SEQ ID NO: 21748 - RNA, 23 nt, Artificial Sequence
  Synthetic
uuuuguggagucaaaaauuauac

SEQ ID NO: 21749 - RNA, 24 nt, Artificial Sequence
  Synthetic
uuuuuguggagucaaaaauuauac

SEQ ID NO: 21750 - RNA, 18 nt, Artificial Sequence
  Synthetic
agugcaaugccauaaacc

SEQ ID NO: 21751 - RNA, 19 nt, Artificial Sequence
  Synthetic
uagugcaaugccauaaacc

SEQ ID NO: 21752 - RNA, 20 nt, Artificial Sequence
  Synthetic
uuagugcaaugccauaaacc

SEQ ID NO: 21753 - RNA, 21 nt, Artificial Sequence
  Synthetic
uuuagugcaaugccauaaacc

SEQ ID NO: 21754 - RNA, 23 nt, Artificial Sequence
  Synthetic
uguuuagugcaaugccauaaacc

SEQ ID NO: 21755 - RNA, 24 nt, Artificial Sequence
  Synthetic
auguuuagugcaaugccauaaacc

SEQ ID NO: 21756 - RNA, 19 nt, Artificial Sequence
  Synthetic
agaaaaaguaagauaugcc

SEQ ID NO: 21757 - RNA, 20 nt, Artificial Sequence
  Synthetic
aagaaaaaguaagauaugcc

SEQ ID NO: 21758 - RNA, 21 nt, Artificial Sequence
  Synthetic
uaagaaaaaguaagauaugcc

SEQ ID NO: 21759 - RNA, 22 nt, Artificial Sequence
  Synthetic
uuaagaaaaaguaagauaugcc

SEQ ID NO: 21760 - RNA, 23 nt, Artificial Sequence
  Synthetic
auuaagaaaaaguaagauaugcc

SEQ ID NO: 21761 - RNA, 24 nt, Artificial Sequence
  Synthetic
aauuaagaaaaaguaagauaugcc

SEQ ID NO: 21762 - RNA, 19 nt, Artificial Sequence
  Synthetic
aggugaauugcuugagucc

SEQ ID NO: 21763 - RNA, 23 nt, Artificial Sequence
  Synthetic
aggcaggugaauugcuugagucc

SEQ ID NO: 21764 - RNA, 21 nt, Artificial Sequence
  Synthetic
cuaaaaccaaacaagcuuucc

SEQ ID NO: 21765 - RNA, 22 nt, Artificial Sequence
  Synthetic
acuaaaaccaaacaagcuuucc

SEQ ID NO: 21766 - RNA, 23 nt, Artificial Sequence
  Synthetic
uacuaaaaccaaacaagcuuucc

SEQ ID NO: 21767 - RNA, 24 nt, Artificial Sequence
  Synthetic
cuacuaaaaccaaacaagcuuucc

SEQ ID NO: 21768 - RNA, 18 nt, Artificial Sequence
  Synthetic
aaauuuucuuuguuuucc

SEQ ID NO: 21769 - RNA, 19 nt, Artificial Sequence
  Synthetic
caaauuuucuuuguuuucc

SEQ ID NO: 21770 - RNA, 20 nt, Artificial Sequence
  Synthetic
acaaauuuucuuuguuuucc

SEQ ID NO: 21771 - RNA, 21 nt, Artificial Sequence
  Synthetic
aacaaauuuucuuuguuuucc

SEQ ID NO: 21772 - RNA, 22 nt, Artificial Sequence
  Synthetic
aaacaaauuuucuuuguuuucc

SEQ ID NO: 21773 - RNA, 23 nt, Artificial Sequence
  Synthetic
aaaacaaauuuucuuuguuuucc

SEQ ID NO: 21774 - RNA, 21 nt, Artificial Sequence
  Synthetic
cagcuuuuaaaacaaaauagc

SEQ ID NO: 21775 - RNA, 22 nt, Artificial Sequence
  Synthetic
acagcuuuuaaaacaaaauagc

SEQ ID NO: 21776 - RNA, 23 nt, Artificial Sequence
  Synthetic
aacagcuuuuaaaacaaaauagc

SEQ ID NO: 21777 - RNA, 24 nt, Artificial Sequence
  Synthetic
aaacagcuuuuaaaacaaaauagc

SEQ ID NO: 21778 - RNA, 19 nt, Artificial Sequence
  Synthetic
cgcgccacugcacucuagc

SEQ ID NO: 21779 - RNA, 20 nt, Artificial Sequence
  Synthetic
ucgcgccacugcacucuagc

SEQ ID NO: 21780 - RNA, 21 nt, Artificial Sequence
  Synthetic
aucgcgccacugcacucuagc

SEQ ID NO: 21781 - RNA, 23 nt, Artificial Sequence
  Synthetic
agaucgcgccacugcacucuagc

SEQ ID NO: 21782 - RNA, 21 nt, Artificial Sequence
  Synthetic
acgggguuucaccguuuuagc

SEQ ID NO: 21783 - RNA, 23 nt, Artificial Sequence
  Synthetic
agacgggguuucaccguuuuagc

SEQ ID NO: 21784 - RNA, 18 nt, Artificial Sequence
  Synthetic
ucgcucugucgcccaggc

SEQ ID NO: 21785 - RNA, 19 nt, Artificial Sequence
  Synthetic
cucgcucugucgcccaggc

SEQ ID NO: 21786 - RNA, 22 nt, Artificial Sequence
  Synthetic
agucucgcucugucgcccaggc

SEQ ID NO: 21787 - RNA, 20 nt, Artificial Sequence
  Synthetic
cgggguuucaccauguuggc

SEQ ID NO: 21788 - RNA, 21 nt, Artificial Sequence
  Synthetic
acgggguuucaccauguuggc

SEQ ID NO: 21789 - RNA, 23 nt, Artificial Sequence
  Synthetic
agacgggguuucaccauguuggc

SEQ ID NO: 21790 - RNA, 18 nt, Artificial Sequence
  Synthetic
aauacaggcuugaacugc

SEQ ID NO: 21791 - RNA, 19 nt, Artificial Sequence
  Synthetic
caauacaggcuugaacugc

SEQ ID NO: 21792 - RNA, 20 nt, Artificial Sequence
  Synthetic
acaauacaggcuugaacugc

SEQ ID NO: 21793 - RNA, 21 nt, Artificial Sequence
  Synthetic
aacaauacaggcuugaacugc

SEQ ID NO: 21794 - RNA, 22 nt, Artificial Sequence
  Synthetic
aaacaauacaggcuugaacugc

SEQ ID NO: 21795 - RNA, 23 nt, Artificial Sequence
  Synthetic
uaaacaauacaggcuugaacugc

SEQ ID NO: 21796 - RNA, 24 nt, Artificial Sequence
  Synthetic
uuaaacaauacaggcuugaacugc

SEQ ID NO: 21797 - RNA, 18 nt, Artificial Sequence
  Synthetic
cucggccucccaaagugc

SEQ ID NO: 21798 - RNA, 19 nt, Artificial Sequence
  Synthetic
ccucggccucccaaagugc

SEQ ID NO: 21799 - RNA, 21 nt, Artificial Sequence
  Synthetic
cgccucggccucccaaagugc

SEQ ID NO: 21800 - RNA, 22 nt, Artificial Sequence
  Synthetic
ccgccucggccucccaaagugc

SEQ ID NO: 21801 - RNA, 23 nt, Artificial Sequence
  Synthetic
cccgccucggccucccaaagugc

SEQ ID NO: 21802 - RNA, 18 nt, Artificial Sequence
  Synthetic
cagaggcaggugaauugc

SEQ ID NO: 21803 - RNA, 21 nt, Artificial Sequence
  Synthetic
aggcagaggcaggugaauugc

SEQ ID NO: 21804 - RNA, 24 nt, Artificial Sequence
  Synthetic
uggaggcagaggcaggugaauugc

SEQ ID NO: 21805 - RNA, 18 nt, Artificial Sequence
  Synthetic
cacugcaagcuccgccuc

SEQ ID NO: 21806 - RNA, 19 nt, Artificial Sequence
  Synthetic
ucacugcaagcuccgccuc

SEQ ID NO: 21807 - RNA, 20 nt, Artificial Sequence
  Synthetic
cucacugcaagcuccgccuc

SEQ ID NO: 21808 - RNA, 23 nt, Artificial Sequence
  Synthetic
cggcucacugcaagcuccgccuc

SEQ ID NO: 21809 - RNA, 24 nt, Artificial Sequence
  Synthetic
ucggcucacugcaagcuccgccuc

SEQ ID NO: 21810 - RNA, 21 nt, Artificial Sequence
  Synthetic
agguucuguaauuuuugcuuc

SEQ ID NO: 21811 - RNA, 22 nt, Artificial Sequence
  Synthetic
uagguucuguaauuuuugcuuc

SEQ ID NO: 21812 - RNA, 23 nt, Artificial Sequence
  Synthetic
auagguucuguaauuuuugcuuc

SEQ ID NO: 21813 - RNA, 24 nt, Artificial Sequence
  Synthetic
uauagguucuguaauuuuugcuuc

SEQ ID NO: 21814 - RNA, 21 nt, Artificial Sequence
  Synthetic
uguaacaguacaagaaaaaag

SEQ ID NO: 21815 - RNA, 22 nt, Artificial Sequence
  Synthetic
uuguaacaguacaagaaaaaag

SEQ ID NO: 21816 - RNA, 24 nt, Artificial Sequence
  Synthetic
aguuguaacaguacaagaaaaaag

SEQ ID NO: 21817 - RNA, 21 nt, Artificial Sequence
  Synthetic
cuuugccauuaacagauaaag

SEQ ID NO: 21818 - RNA, 23 nt, Artificial Sequence
  Synthetic
ugcuuugccauuaacagauaaag

SEQ ID NO: 21819 - RNA, 24 nt, Artificial Sequence
  Synthetic
uugcuuugccauuaacagauaaag

SEQ ID NO: 21820 - RNA, 18 nt, Artificial Sequence
  Synthetic
uuuuggaggcagaggcag

SEQ ID NO: 21821 - RNA, 19 nt, Artificial Sequence
  Synthetic
cuuuuggaggcagaggcag

SEQ ID NO: 21822 - RNA, 20 nt, Artificial Sequence
  Synthetic
acuuuuggaggcagaggcag

SEQ ID NO: 21823 - RNA, 21 nt, Artificial Sequence
  Synthetic
cacuuuuggaggcagaggcag

SEQ ID NO: 21824 - RNA, 23 nt, Artificial Sequence
  Synthetic
agcacuuuuggaggcagaggcag

SEQ ID NO: 21825 - RNA, 24 nt, Artificial Sequence
  Synthetic
uagcacuuuuggaggcagaggcag

SEQ ID NO: 21826 - RNA, 18 nt, Artificial Sequence
  Synthetic
cucgggaggcugaggcag

SEQ ID NO: 21827 - RNA, 19 nt, Artificial Sequence
  Synthetic
acucgggaggcugaggcag

SEQ ID NO: 21828 - RNA, 20 nt, Artificial Sequence
  Synthetic
uacucgggaggcugaggcag

SEQ ID NO: 21829 - RNA, 21 nt, Artificial Sequence
  Synthetic
cuacucgggaggcugaggcag

SEQ ID NO: 21830 - RNA, 23 nt, Artificial Sequence
  Synthetic
agcuacucgggaggcugaggcag

SEQ ID NO: 21831 - RNA, 24 nt, Artificial Sequence
  Synthetic
cagcuacucgggaggcugaggcag

SEQ ID NO: 21832 - RNA, 18 nt, Artificial Sequence
  Synthetic
aagggaggaagcaaggag

SEQ ID NO: 21833 - RNA, 19 nt, Artificial Sequence
  Synthetic
caagggaggaagcaaggag

SEQ ID NO: 21834 - RNA, 20 nt, Artificial Sequence
  Synthetic
acaagggaggaagcaaggag

SEQ ID NO: 21835 - RNA, 22 nt, Artificial Sequence
  Synthetic
agacaagggaggaagcaaggag

SEQ ID NO: 21836 - RNA, 18 nt, Artificial Sequence
  Synthetic
acaaacaaaagaaaauag

SEQ ID NO: 21837 - RNA, 19 nt, Artificial Sequence
  Synthetic
cacaaacaaaagaaaauag

SEQ ID NO: 21838 - RNA, 20 nt, Artificial Sequence
  Synthetic
acacaaacaaaagaaaauag

SEQ ID NO: 21839 - RNA, 21 nt, Artificial Sequence
  Synthetic
aacacaaacaaaagaaaauag

SEQ ID NO: 21840 - RNA, 22 nt, Artificial Sequence
  Synthetic
aaacacaaacaaaagaaaauag

SEQ ID NO: 21841 - RNA, 23 nt, Artificial Sequence
  Synthetic
aaaacacaaacaaaagaaaauag

SEQ ID NO: 21842 - RNA, 24 nt, Artificial Sequence
  Synthetic
aaaaacacaaacaaaagaaaauag

SEQ ID NO: 21843 - RNA, 18 nt, Artificial Sequence
  Synthetic
uccaaauagagauguuag

SEQ ID NO: 21844 - RNA, 19 nt, Artificial Sequence
  Synthetic
auccaaauagagauguuag

SEQ ID NO: 21845 - RNA, 20 nt, Artificial Sequence
  Synthetic
cauccaaauagagauguuag

SEQ ID NO: 21846 - RNA, 21 nt, Artificial Sequence
  Synthetic
acauccaaauagagauguuag

SEQ ID NO: 21847 - RNA, 23 nt, Artificial Sequence
  Synthetic
ugacauccaaauagagauguuag

SEQ ID NO: 21848 - RNA, 24 nt, Artificial Sequence
  Synthetic
uugacauccaaauagagauguuag

SEQ ID NO: 21849 - RNA, 18 nt, Artificial Sequence
  Synthetic
agaguaagacagggaggg

SEQ ID NO: 21850 - RNA, 19 nt, Artificial Sequence
  Synthetic
uagaguaagacagggaggg

SEQ ID NO: 21851 - RNA, 20 nt, Artificial Sequence
  Synthetic
auagaguaagacagggaggg

SEQ ID NO: 21852 - RNA, 21 nt, Artificial Sequence
  Synthetic
cauagaguaagacagggaggg

SEQ ID NO: 21853 - RNA, 24 nt, Artificial Sequence
  Synthetic
uggcauagaguaagacagggaggg

SEQ ID NO: 21854 - RNA, 18 nt, Artificial Sequence
  Synthetic
uaguauucuaucauaugg

SEQ ID NO: 21855 - RNA, 19 nt, Artificial Sequence
  Synthetic
auaguauucuaucauaugg

SEQ ID NO: 21856 - RNA, 20 nt, Artificial Sequence
  Synthetic
cauaguauucuaucauaugg

SEQ ID NO: 21857 - RNA, 22 nt, Artificial Sequence
  Synthetic
ugcauaguauucuaucauaugg

SEQ ID NO: 21858 - RNA, 23 nt, Artificial Sequence
  Synthetic
augcauaguauucuaucauaugg

SEQ ID NO: 21859 - RNA, 18 nt, Artificial Sequence
  Synthetic
ucuggacugaguaacugg

SEQ ID NO: 21860 - RNA, 19 nt, Artificial Sequence
  Synthetic
uucuggacugaguaacugg

SEQ ID NO: 21861 - RNA, 20 nt, Artificial Sequence
  Synthetic
uuucuggacugaguaacugg

SEQ ID NO: 21862 - RNA, 21 nt, Artificial Sequence
  Synthetic
cuuucuggacugaguaacugg

SEQ ID NO: 21863 - RNA, 23 nt, Artificial Sequence
  Synthetic
agcuuucuggacugaguaacugg

SEQ ID NO: 21864 - RNA, 24 nt, Artificial Sequence
  Synthetic
aagcuuucuggacugaguaacugg

SEQ ID NO: 21865 - RNA, 19 nt, Artificial Sequence
  Synthetic
uguauauaugugugucugg

SEQ ID NO: 21866 - RNA, 20 nt, Artificial Sequence
  Synthetic
auguauauaugugugucugg

SEQ ID NO: 21867 - RNA, 21 nt, Artificial Sequence
  Synthetic
uauguauauaugugugucugg

SEQ ID NO: 21868 - RNA, 23 nt, Artificial Sequence
  Synthetic
uguauguauauaugugugucugg

SEQ ID NO: 21869 - RNA, 24 nt, Artificial Sequence
  Synthetic
auguauguauauaugugugucugg

SEQ ID NO: 21870 - RNA, 18 nt, Artificial Sequence
  Synthetic
caggcuggagugcagugg

SEQ ID NO: 21871 - RNA, 19 nt, Artificial Sequence
  Synthetic
ccaggcuggagugcagugg

SEQ ID NO: 21872 - RNA, 22 nt, Artificial Sequence
  Synthetic
cgcccaggcuggagugcagugg

SEQ ID NO: 21873 - RNA, 23 nt, Artificial Sequence
  Synthetic
ucgcccaggcuggagugcagugg

SEQ ID NO: 21874 - RNA, 18 nt, Artificial Sequence
  Synthetic
cuugggaggcugaggugg

SEQ ID NO: 21875 - RNA, 19 nt, Artificial Sequence
  Synthetic
acuugggaggcugaggugg

SEQ ID NO: 21876 - RNA, 20 nt, Artificial Sequence
  Synthetic
uacuugggaggcugaggugg

SEQ ID NO: 21877 - RNA, 21 nt, Artificial Sequence
  Synthetic
cuacuugggaggcugaggugg

SEQ ID NO: 21878 - RNA, 23 nt, Artificial Sequence
  Synthetic
agcuacuugggaggcugaggugg

SEQ ID NO: 21879 - RNA, 24 nt, Artificial Sequence
  Synthetic
cagcuacuugggaggcugaggugg

SEQ ID NO: 21880 - RNA, 23 nt, Artificial Sequence
  Synthetic
ugggugggggagccccauaaaug

SEQ ID NO: 21881 - RNA, 24 nt, Artificial Sequence
  Synthetic
uugggugggggagccccauaaaug

SEQ ID NO: 21882 - RNA, 18 nt, Artificial Sequence
  Synthetic
aauuagccagacgugaug

SEQ ID NO: 21883 - RNA, 19 nt, Artificial Sequence
  Synthetic
aaauuagccagacgugaug

SEQ ID NO: 21884 - RNA, 20 nt, Artificial Sequence
  Synthetic
aaaauuagccagacgugaug

SEQ ID NO: 21885 - RNA, 21 nt, Artificial Sequence
  Synthetic
aaaaauuagccagacgugaug

SEQ ID NO: 21886 - RNA, 22 nt, Artificial Sequence
  Synthetic
aaaaaauuagccagacgugaug

SEQ ID NO: 21887 - RNA, 23 nt, Artificial Sequence
  Synthetic
caaaaaauuagccagacgugaug

SEQ ID NO: 21888 - RNA, 24 nt, Artificial Sequence
  Synthetic
acaaaaaauuagccagacgugaug

SEQ ID NO: 21889 - RNA, 22 nt, Artificial Sequence
  Synthetic
ugggugagauuagaggccacug

SEQ ID NO: 21890 - RNA, 23 nt, Artificial Sequence
  Synthetic
cugggugagauuagaggccacug

SEQ ID NO: 21891 - RNA, 24 nt, Artificial Sequence
  Synthetic
ucugggugagauuagaggccacug

SEQ ID NO: 21892 - RNA, 18 nt, Artificial Sequence
  Synthetic
cuucagccucccaaagug

SEQ ID NO: 21893 - RNA, 20 nt, Artificial Sequence
  Synthetic
cgcuucagccucccaaagug

SEQ ID NO: 21894 - RNA, 21 nt, Artificial Sequence
  Synthetic
ccgcuucagccucccaaagug

SEQ ID NO: 21895 - RNA, 22 nt, Artificial Sequence
  Synthetic
uccgcuucagccucccaaagug

SEQ ID NO: 21896 - RNA, 23 nt, Artificial Sequence
  Synthetic
uuccgcuucagccucccaaagug

SEQ ID NO: 21897 - RNA, 24 nt, Artificial Sequence
  Synthetic
uuuccgcuucagccucccaaagug

SEQ ID NO: 21898 - RNA, 18 nt, Artificial Sequence
  Synthetic
aaagacuugcaggaggug

SEQ ID NO: 21899 - RNA, 19 nt, Artificial Sequence
  Synthetic
caaagacuugcaggaggug

SEQ ID NO: 21900 - RNA, 21 nt, Artificial Sequence
  Synthetic
aacaaagacuugcaggaggug

SEQ ID NO: 21901 - RNA, 23 nt, Artificial Sequence
  Synthetic
ugaacaaagacuugcaggaggug

SEQ ID NO: 21902 - RNA, 24 nt, Artificial Sequence
  Synthetic
uugaacaaagacuugcaggaggug

SEQ ID NO: 21903 - RNA, 23 nt, Artificial Sequence
  Synthetic
agguuuguuaaagaaugacugug

SEQ ID NO: 21904 - RNA, 24 nt, Artificial Sequence
  Synthetic
aagguuuguuaaagaaugacugug

SEQ ID NO: 21905 - RNA, 18 nt, Artificial Sequence
  Synthetic
cccaaggugaugguauug

SEQ ID NO: 21906 - RNA, 19 nt, Artificial Sequence
  Synthetic
ucccaaggugaugguauug

SEQ ID NO: 21907 - RNA, 20 nt, Artificial Sequence
  Synthetic
uucccaaggugaugguauug

SEQ ID NO: 21908 - RNA, 21 nt, Artificial Sequence
  Synthetic
auucccaaggugaugguauug

SEQ ID NO: 21909 - RNA, 22 nt, Artificial Sequence
  Synthetic
aauucccaaggugaugguauug

SEQ ID NO: 21910 - RNA, 23 nt, Artificial Sequence
  Synthetic
uaauucccaaggugaugguauug

SEQ ID NO: 21911 - RNA, 24 nt, Artificial Sequence
  Synthetic
cuaauucccaaggugaugguauug

SEQ ID NO: 21912 - RNA, 18 nt, Artificial Sequence
  Synthetic
uuaguaguuaaguuuuug

SEQ ID NO: 21913 - RNA, 19 nt, Artificial Sequence
  Synthetic
auuaguaguuaaguuuuug

SEQ ID NO: 21914 - RNA, 21 nt, Artificial Sequence
  Synthetic
cuauuaguaguuaaguuuuug

SEQ ID NO: 21915 - RNA, 24 nt, Artificial Sequence
  Synthetic
aggcuauuaguaguuaaguuuuug

SEQ ID NO: 21916 - RNA, 21 nt, Artificial Sequence
  Synthetic
ucagauuuuuucccauguaau

SEQ ID NO: 21917 - RNA, 22 nt, Artificial Sequence
  Synthetic
uucagauuuuuucccauguaau

SEQ ID NO: 21918 - RNA, 23 nt, Artificial Sequence
  Synthetic
auucagauuuuuucccauguaau

SEQ ID NO: 21919 - RNA, 24 nt, Artificial Sequence
  Synthetic
aauucagauuuuuucccauguaau

SEQ ID NO: 21920 - RNA, 19 nt, Artificial Sequence
  Synthetic
ugggaggugauuaguccau

SEQ ID NO: 21921 - RNA, 20 nt, Artificial Sequence
  Synthetic
uugggaggugauuaguccau

SEQ ID NO: 21922 - RNA, 21 nt, Artificial Sequence
  Synthetic
uuugggaggugauuaguccau

SEQ ID NO: 21923 - RNA, 22 nt, Artificial Sequence
  Synthetic
cuuugggaggugauuaguccau

SEQ ID NO: 21924 - RNA, 23 nt, Artificial Sequence
  Synthetic
ccuuugggaggugauuaguccau

SEQ ID NO: 21925 - RNA, 18 nt, Artificial Sequence
  Synthetic
ugcauaguauucuaucau

SEQ ID NO: 21926 - RNA, 19 nt, Artificial Sequence
  Synthetic
augcauaguauucuaucau

SEQ ID NO: 21927 - RNA, 21 nt, Artificial Sequence
  Synthetic
agaugcauaguauucuaucau

SEQ ID NO: 21928 - RNA, 22 nt, Artificial Sequence
  Synthetic
uagaugcauaguauucuaucau

SEQ ID NO: 21929 - RNA, 23 nt, Artificial Sequence
  Synthetic
auagaugcauaguauucuaucau

SEQ ID NO: 21930 - RNA, 24 nt, Artificial Sequence
  Synthetic
aauagaugcauaguauucuaucau

SEQ ID NO: 21931 - RNA, 21 nt, Artificial Sequence
  Synthetic
ugagaaagagcuuucuaguau

SEQ ID NO: 21932 - RNA, 22 nt, Artificial Sequence
  Synthetic
augagaaagagcuuucuaguau

SEQ ID NO: 21933 - RNA, 24 nt, Artificial Sequence
  Synthetic
agaugagaaagagcuuucuaguau

SEQ ID NO: 21934 - RNA, 21 nt, Artificial Sequence
  Synthetic
uaaaaagcugugcauuuuccu

SEQ ID NO: 21935 - RNA, 22 nt, Artificial Sequence
  Synthetic
uuaaaaagcugugcauuuuccu

SEQ ID NO: 21936 - RNA, 23 nt, Artificial Sequence
  Synthetic
uuuaaaaagcugugcauuuuccu

SEQ ID NO: 21937 - RNA, 24 nt, Artificial Sequence
  Synthetic
uuuuaaaaagcugugcauuuuccu

SEQ ID NO: 21938 - RNA, 18 nt, Artificial Sequence
  Synthetic
caaauuauuucuacugcu

SEQ ID NO: 21939 - RNA, 19 nt, Artificial Sequence
  Synthetic
ucaaauuauuucuacugcu

SEQ ID NO: 21940 - RNA, 22 nt, Artificial Sequence
  Synthetic
ugucuguaggcuauauguaucu

SEQ ID NO: 21941 - RNA, 23 nt, Artificial Sequence
  Synthetic
uugucuguaggcuauauguaucu

SEQ ID NO: 21942 - RNA, 24 nt, Artificial Sequence
  Synthetic
auugucuguaggcuauauguaucu

SEQ ID NO: 21943 - RNA, 18 nt, Artificial Sequence
  Synthetic
cucggccucccaaagugu

SEQ ID NO: 21944 - RNA, 19 nt, Artificial Sequence
  Synthetic
ccucggccucccaaagugu

SEQ ID NO: 21945 - RNA, 21 nt, Artificial Sequence
  Synthetic
ugccucggccucccaaagugu

SEQ ID NO: 21946 - RNA, 22 nt, Artificial Sequence
  Synthetic
cugccucggccucccaaagugu

SEQ ID NO: 21947 - RNA, 23 nt, Artificial Sequence
  Synthetic
ccugccucggccucccaaagugu

SEQ ID NO: 21948 - RNA, 19 nt, Artificial Sequence
  Synthetic
aggaaggcaguggucccuu

SEQ ID NO: 21949 - RNA, 24 nt, Artificial Sequence
  Synthetic
agggaggaagcaaggagaugaguu

SEQ ID NO: 21950 - RNA, 21 nt, Artificial Sequence
  Synthetic
agauaaugggagaaacagguu

SEQ ID NO: 21951 - RNA, 22 nt, Artificial Sequence
  Synthetic
aagauaaugggagaaacagguu

SEQ ID NO: 21952 - RNA, 23 nt, Artificial Sequence
  Synthetic
aaagauaaugggagaaacagguu

SEQ ID NO: 21953 - RNA, 18 nt, Artificial Sequence
  Synthetic
auaguuuuaucaauauuu

SEQ ID NO: 21954 - RNA, 19 nt, Artificial Sequence
  Synthetic
aauaguuuuaucaauauuu

SEQ ID NO: 21955 - RNA, 19 nt, Artificial Sequence
  Synthetic
ugcauggguccacuuauuu

SEQ ID NO: 21956 - RNA, 20 nt, Artificial Sequence
  Synthetic
cugcauggguccacuuauuu

SEQ ID NO: 21957 - RNA, 21 nt, Artificial Sequence
  Synthetic
acugcauggguccacuuauuu

SEQ ID NO: 21958 - RNA, 22 nt, Artificial Sequence
  Synthetic
aacugcauggguccacuuauuu

SEQ ID NO: 21959 - RNA, 24 nt, Artificial Sequence
  Synthetic
ugaacugcauggguccacuuauuu

SEQ ID NO: 21960 - RNA, 18 nt, Artificial Sequence
  Synthetic
uuguuguuuuucuaguuu

SEQ ID NO: 21961 - RNA, 19 nt, Artificial Sequence
  Synthetic
uuuguuguuuuucuaguuu

SEQ ID NO: 21962 - RNA, 20 nt, Artificial Sequence
  Synthetic
uuuuguuguuuuucuaguuu

SEQ ID NO: 21963 - RNA, 21 nt, Artificial Sequence
  Synthetic
uuuuuguuguuuuucuaguuu

SEQ ID NO: 21964 - RNA, 22 nt, Artificial Sequence
  Synthetic
uuuuuuguuguuuuucuaguuu

SEQ ID NO: 21965 - RNA, 23 nt, Artificial Sequence
  Synthetic
cuuuuuuguuguuuuucuaguuu

SEQ ID NO: 21966 - RNA, 18 nt, Artificial Sequence
  Synthetic
aauacauuggaaaauuuu

SEQ ID NO: 21967 - RNA, 19 nt, Artificial Sequence
  Synthetic
uaauacauuggaaaauuuu

SEQ ID NO: 21968 - RNA, 22 nt, Artificial Sequence
  Synthetic
aguuaauacauuggaaaauuuu

SEQ ID NO: 21969 - RNA, 23 nt, Artificial Sequence
  Synthetic
caguuaauacauuggaaaauuuu

SEQ ID NO: 21970 - RNA, 24 nt, Artificial Sequence
  Synthetic
ucaguuaauacauuggaaaauuuu

SEQ ID NO: 21971 - RNA, 21 nt, Artificial Sequence
  Synthetic
uauguccuccacaaauauuuu

SEQ ID NO: 21972 - RNA, 23 nt, Artificial Sequence
  Synthetic
aguauguccuccacaaauauuuu

SEQ ID NO: 21973 - RNA, 24 nt, Artificial Sequence
  Synthetic
aaguauguccuccacaaauauuuu

SEQ ID NO: 21974 - RNA, 18 nt, Artificial Sequence
  Synthetic
aaaaaaaaaaaaaaaaaa

SEQ ID NO: 21975 - RNA, 19 nt, Artificial Sequence
  Synthetic
aaaaaaaaaaaaaaaaaaa

SEQ ID NO: 21976 - RNA, 20 nt, Artificial Sequence
  Synthetic
aaaaaaaaaaaaaaaaaaaa

SEQ ID NO: 21977 - RNA, 21 nt, Artificial Sequence
  Synthetic
aaaaaaaaaaaaaaaaaaaaa

SEQ ID NO: 21978 - RNA, 22 nt, Artificial Sequence
  Synthetic
aaaaaaaaaaaaaaaaaaaaaa

SEQ ID NO: 21979 - RNA, 23 nt, Artificial Sequence
  Synthetic
aaaaaaaaaaaaaaaaaaaaaaa

SEQ ID NO: 21980 - RNA, 24 nt, Artificial Sequence
  Synthetic
caaaaaaaaaaaaaaaaaaaaaaa

SEQ ID NO: 21981 - RNA, 18 nt, Artificial Sequence
  Synthetic
uagaaaaacaacaaaaaa

SEQ ID NO: 21982 - RNA, 19 nt, Artificial Sequence
  Synthetic
cuagaaaaacaacaaaaaa

SEQ ID NO: 21983 - RNA, 20 nt, Artificial Sequence
  Synthetic
acuagaaaaacaacaaaaaa

SEQ ID NO: 21984 - RNA, 21 nt, Artificial Sequence
  Synthetic
aacuagaaaaacaacaaaaaa

SEQ ID NO: 21985 - RNA, 22 nt, Artificial Sequence
  Synthetic
aaacuagaaaaacaacaaaaaa

SEQ ID NO: 21986 - RNA, 23 nt, Artificial Sequence
  Synthetic
aaaacuagaaaaacaacaaaaaa

SEQ ID NO: 21987 - RNA, 24 nt, Artificial Sequence
  Synthetic
aaaaacuagaaaaacaacaaaaaa

SEQ ID NO: 21988 - RNA, 18 nt, Artificial Sequence
  Synthetic
caaacaaagaaacaaaaa

SEQ ID NO: 21989 - RNA, 19 nt, Artificial Sequence
  Synthetic
acaaacaaagaaacaaaaa

SEQ ID NO: 21990 - RNA, 20 nt, Artificial Sequence
  Synthetic
uacaaacaaagaaacaaaaa

SEQ ID NO: 21991 - RNA, 21 nt, Artificial Sequence
  Synthetic
auacaaacaaagaaacaaaaa

SEQ ID NO: 21992 - RNA, 22 nt, Artificial Sequence
  Synthetic
aauacaaacaaagaaacaaaaa

SEQ ID NO: 21993 - RNA, 23 nt, Artificial Sequence
  Synthetic
aaauacaaacaaagaaacaaaaa

SEQ ID NO: 21994 - RNA, 24 nt, Artificial Sequence
  Synthetic
uaaauacaaacaaagaaacaaaaa

SEQ ID NO: 21995 - RNA, 18 nt, Artificial Sequence
  Synthetic
cauauuguuacauaaaaa

SEQ ID NO: 21996 - RNA, 19 nt, Artificial Sequence
  Synthetic
gcauauuguuacauaaaaa

SEQ ID NO: 21997 - RNA, 20 nt, Artificial Sequence
  Synthetic
ugcauauuguuacauaaaaa

SEQ ID NO: 21998 - RNA, 21 nt, Artificial Sequence
  Synthetic
cugcauauuguuacauaaaaa

SEQ ID NO: 21999 - RNA, 22 nt, Artificial Sequence
  Synthetic
ucugcauauuguuacauaaaaa

SEQ ID NO: 22000 - RNA, 23 nt, Artificial Sequence
  Synthetic
cucugcauauuguuacauaaaaa

SEQ ID NO: 22001 - RNA, 24 nt, Artificial Sequence
  Synthetic
acucugcauauuguuacauaaaaa

SEQ ID NO: 22002 - RNA, 18 nt, Artificial Sequence
  Synthetic
gugcauaaagguugaaaa

SEQ ID NO: 22003 - RNA, 19 nt, Artificial Sequence
  Synthetic
agugcauaaagguugaaaa

SEQ ID NO: 22004 - RNA, 21 nt, Artificial Sequence
  Synthetic
agagugcauaaagguugaaaa

SEQ ID NO: 22005 - RNA, 22 nt, Artificial Sequence
  Synthetic
aagagugcauaaagguugaaaa

SEQ ID NO: 22006 - RNA, 23 nt, Artificial Sequence
  Synthetic
aaagagugcauaaagguugaaaa

SEQ ID NO: 22007 - RNA, 24 nt, Artificial Sequence
  Synthetic
caaagagugcauaaagguugaaaa

SEQ ID NO: 22008 - RNA, 18 nt, Artificial Sequence
  Synthetic
uuuccucaauaguuaaaa

SEQ ID NO: 22009 - RNA, 19 nt, Artificial Sequence
  Synthetic
auuuccucaauaguuaaaa

SEQ ID NO: 22010 - RNA, 20 nt, Artificial Sequence
  Synthetic
uauuuccucaauaguuaaaa

SEQ ID NO: 22011 - RNA, 21 nt, Artificial Sequence
  Synthetic
uuauuuccucaauaguuaaaa

SEQ ID NO: 22012 - RNA, 22 nt, Artificial Sequence
  Synthetic
uuuauuuccucaauaguuaaaa

SEQ ID NO: 22013 - RNA, 23 nt, Artificial Sequence
  Synthetic
auuuauuuccucaauaguuaaaa

SEQ ID NO: 22014 - RNA, 24 nt, Artificial Sequence
  Synthetic
aauuuauuuccucaauaguuaaaa

SEQ ID NO: 22015 - RNA, 18 nt, Artificial Sequence
  Synthetic
uaguaaaaaaaaaucaaa

SEQ ID NO: 22016 - RNA, 19 nt, Artificial Sequence
  Synthetic
uuaguaaaaaaaaaucaaa

SEQ ID NO: 22017 - RNA, 21 nt, Artificial Sequence
  Synthetic
aauuaguaaaaaaaaaucaaa

SEQ ID NO: 22018 - RNA, 22 nt, Artificial Sequence
  Synthetic
aaauuaguaaaaaaaaaucaaa

SEQ ID NO: 22019 - RNA, 23 nt, Artificial Sequence
  Synthetic
aaaauuaguaaaaaaaaaucaaa

SEQ ID NO: 22020 - RNA, 24 nt, Artificial Sequence
  Synthetic
caaaauuaguaaaaaaaaaucaaa

SEQ ID NO: 22021 - RNA, 18 nt, Artificial Sequence
  Synthetic
gcuaaaaugacaaucaaa

SEQ ID NO: 22022 - RNA, 19 nt, Artificial Sequence
  Synthetic
agcuaaaaugacaaucaaa

SEQ ID NO: 22023 - RNA, 21 nt, Artificial Sequence
  Synthetic
acagcuaaaaugacaaucaaa

SEQ ID NO: 22024 - RNA, 22 nt, Artificial Sequence
  Synthetic
cacagcuaaaaugacaaucaaa

SEQ ID NO: 22025 - RNA, 23 nt, Artificial Sequence
  Synthetic
ccacagcuaaaaugacaaucaaa

SEQ ID NO: 22026 - RNA, 24 nt, Artificial Sequence
  Synthetic
accacagcuaaaaugacaaucaaa

SEQ ID NO: 22027 - RNA, 18 nt, Artificial Sequence
  Synthetic
aggauaucuuaggucaaa

SEQ ID NO: 22028 - RNA, 19 nt, Artificial Sequence
  Synthetic
uaggauaucuuaggucaaa

SEQ ID NO: 22029 - RNA, 20 nt, Artificial Sequence
  Synthetic
uuaggauaucuuaggucaaa

SEQ ID NO: 22030 - RNA, 21 nt, Artificial Sequence
  Synthetic
cuuaggauaucuuaggucaaa

SEQ ID NO: 22031 - RNA, 22 nt, Artificial Sequence
  Synthetic
ccuuaggauaucuuaggucaaa

SEQ ID NO: 22032 - RNA, 23 nt, Artificial Sequence
  Synthetic
cccuuaggauaucuuaggucaaa

SEQ ID NO: 22033 - RNA, 24 nt, Artificial Sequence
  Synthetic
ucccuuaggauaucuuaggucaaa

SEQ ID NO: 22034 - RNA, 18 nt, Artificial Sequence
  Synthetic
aaugcaggagaauggaaa

SEQ ID NO: 22035 - RNA, 19 nt, Artificial Sequence
  Synthetic
gaaugcaggagaauggaaa

SEQ ID NO: 22036 - RNA, 20 nt, Artificial Sequence
  Synthetic
ggaaugcaggagaauggaaa

SEQ ID NO: 22037 - RNA, 21 nt, Artificial Sequence
  Synthetic
gggaaugcaggagaauggaaa

SEQ ID NO: 22038 - RNA, 22 nt, Artificial Sequence
  Synthetic
agggaaugcaggagaauggaaa

SEQ ID NO: 22039 - RNA, 23 nt, Artificial Sequence
  Synthetic
gagggaaugcaggagaauggaaa

SEQ ID NO: 22040 - RNA, 24 nt, Artificial Sequence
  Synthetic
ugagggaaugcaggagaauggaaa

SEQ ID NO: 22041 - RNA, 18 nt, Artificial Sequence
  Synthetic
caaauacauucaaugaaa

SEQ ID NO: 22042 - RNA, 19 nt, Artificial Sequence
  Synthetic
ccaaauacauucaaugaaa

SEQ ID NO: 22043 - RNA, 20 nt, Artificial Sequence
  Synthetic
cccaaauacauucaaugaaa

SEQ ID NO: 22044 - RNA, 21 nt, Artificial Sequence
  Synthetic
gcccaaauacauucaaugaaa

SEQ ID NO: 22045 - RNA, 22 nt, Artificial Sequence
  Synthetic
ggcccaaauacauucaaugaaa

SEQ ID NO: 22046 - RNA, 23 nt, Artificial Sequence
  Synthetic
aggcccaaauacauucaaugaaa

SEQ ID NO: 22047 - RNA, 24 nt, Artificial Sequence
  Synthetic
caggcccaaauacauucaaugaaa

SEQ ID NO: 22048 - RNA, 18 nt, Artificial Sequence
  Synthetic
agugcauaaagguugaaa

SEQ ID NO: 22049 - RNA, 19 nt, Artificial Sequence
  Synthetic
gagugcauaaagguugaaa

SEQ ID NO: 22050 - RNA, 20 nt, Artificial Sequence
  Synthetic
agagugcauaaagguugaaa

SEQ ID NO: 22051 - RNA, 21 nt, Artificial Sequence
  Synthetic
aagagugcauaaagguugaaa

SEQ ID NO: 22052 - RNA, 22 nt, Artificial Sequence
  Synthetic
aaagagugcauaaagguugaaa

SEQ ID NO: 22053 - RNA, 23 nt, Artificial Sequence
  Synthetic
caaagagugcauaaagguugaaa

SEQ ID NO: 22054 - RNA, 24 nt, Artificial Sequence
  Synthetic
gcaaagagugcauaaagguugaaa

SEQ ID NO: 22055 - RNA, 18 nt, Artificial Sequence
  Synthetic
ugcauauuguuacauaaa

SEQ ID NO: 22056 - RNA, 19 nt, Artificial Sequence
  Synthetic
cugcauauuguuacauaaa

SEQ ID NO: 22057 - RNA, 20 nt, Artificial Sequence
  Synthetic
ucugcauauuguuacauaaa

SEQ ID NO: 22058 - RNA, 21 nt, Artificial Sequence
  Synthetic
cucugcauauuguuacauaaa

SEQ ID NO: 22059 - RNA, 22 nt, Artificial Sequence
  Synthetic
acucugcauauuguuacauaaa

SEQ ID NO: 22060 - RNA, 23 nt, Artificial Sequence
  Synthetic
aacucugcauauuguuacauaaa

SEQ ID NO: 22061 - RNA, 24 nt, Artificial Sequence
  Synthetic
aaacucugcauauuguuacauaaa

SEQ ID NO: 22062 - RNA, 18 nt, Artificial Sequence
  Synthetic
ucguauguaggaaaacaa

SEQ ID NO: 22063 - RNA, 19 nt, Artificial Sequence
  Synthetic
uucguauguaggaaaacaa

SEQ ID NO: 22064 - RNA, 20 nt, Artificial Sequence
  Synthetic
uuucguauguaggaaaacaa

SEQ ID NO: 22065 - RNA, 21 nt, Artificial Sequence
  Synthetic
guuucguauguaggaaaacaa

SEQ ID NO: 22066 - RNA, 22 nt, Artificial Sequence
  Synthetic
uguuucguauguaggaaaacaa

SEQ ID NO: 22067 - RNA, 23 nt, Artificial Sequence
  Synthetic
cuguuucguauguaggaaaacaa

SEQ ID NO: 22068 - RNA, 24 nt, Artificial Sequence
  Synthetic
gcuguuucguauguaggaaaacaa

SEQ ID NO: 22069 - RNA, 18 nt, Artificial Sequence
  Synthetic
aaccaaauaaacaaacaa

SEQ ID NO: 22070 - RNA, 19 nt, Artificial Sequence
  Synthetic
aaaccaaauaaacaaacaa

SEQ ID NO: 22071 - RNA, 21 nt, Artificial Sequence
  Synthetic
aaaaaccaaauaaacaaacaa

SEQ ID NO: 22072 - RNA, 22 nt, Artificial Sequence
  Synthetic
uaaaaaccaaauaaacaaacaa

SEQ ID NO: 22073 - RNA, 23 nt, Artificial Sequence
  Synthetic
guaaaaaccaaauaaacaaacaa

SEQ ID NO: 22074 - RNA, 24 nt, Artificial Sequence
  Synthetic
aguaaaaaccaaauaaacaaacaa

SEQ ID NO: 22075 - RNA, 18 nt, Artificial Sequence
  Synthetic
uguguggcuuauaaacaa

SEQ ID NO: 22076 - RNA, 19 nt, Artificial Sequence
  Synthetic
cuguguggcuuauaaacaa

SEQ ID NO: 22077 - RNA, 20 nt, Artificial Sequence
  Synthetic
acuguguggcuuauaaacaa

SEQ ID NO: 22078 - RNA, 21 nt, Artificial Sequence
  Synthetic
aacuguguggcuuauaaacaa

SEQ ID NO: 22079 - RNA, 22 nt, Artificial Sequence
  Synthetic
gaacuguguggcuuauaaacaa

SEQ ID NO: 22080 - RNA, 23 nt, Artificial Sequence
  Synthetic
ugaacuguguggcuuauaaacaa

SEQ ID NO: 22081 - RNA, 24 nt, Artificial Sequence
  Synthetic
augaacuguguggcuuauaaacaa

SEQ ID NO: 22082 - RNA, 18 nt, Artificial Sequence
  Synthetic
cagcugugaugcagacaa

SEQ ID NO: 22083 - RNA, 19 nt, Artificial Sequence
  Synthetic
ucagcugugaugcagacaa

SEQ ID NO: 22084 - RNA, 20 nt, Artificial Sequence
  Synthetic
uucagcugugaugcagacaa

SEQ ID NO: 22085 - RNA, 21 nt, Artificial Sequence
  Synthetic
cuucagcugugaugcagacaa

SEQ ID NO: 22086 - RNA, 22 nt, Artificial Sequence
  Synthetic
gcuucagcugugaugcagacaa

SEQ ID NO: 22087 - RNA, 23 nt, Artificial Sequence
  Synthetic
ugcuucagcugugaugcagacaa

SEQ ID NO: 22088 - RNA, 24 nt, Artificial Sequence
  Synthetic
cugcuucagcugugaugcagacaa

SEQ ID NO: 22089 - RNA, 18 nt, Artificial Sequence
  Synthetic
uaaugaguuacaauacaa

SEQ ID NO: 22090 - RNA, 19 nt, Artificial Sequence
  Synthetic
uuaaugaguuacaauacaa

SEQ ID NO: 22091 - RNA, 20 nt, Artificial Sequence
  Synthetic
auuaaugaguuacaauacaa

SEQ ID NO: 22092 - RNA, 21 nt, Artificial Sequence
  Synthetic
aauuaaugaguuacaauacaa

SEQ ID NO: 22093 - RNA, 22 nt, Artificial Sequence
  Synthetic
aaauuaaugaguuacaauacaa

SEQ ID NO: 22094 - RNA, 23 nt, Artificial Sequence
  Synthetic
uaaauuaaugaguuacaauacaa

SEQ ID NO: 22095 - RNA, 24 nt, Artificial Sequence
  Synthetic
auaaauuaaugaguuacaauacaa

SEQ ID NO: 22096 - RNA, 18 nt, Artificial Sequence
  Synthetic
agcuuaccguaauagcaa

SEQ ID NO: 22097 - RNA, 19 nt, Artificial Sequence
  Synthetic
gagcuuaccguaauagcaa

SEQ ID NO: 22098 - RNA, 20 nt, Artificial Sequence
  Synthetic
ugagcuuaccguaauagcaa

SEQ ID NO: 22099 - RNA, 21 nt, Artificial Sequence
  Synthetic
uugagcuuaccguaauagcaa

SEQ ID NO: 22100 - RNA, 22 nt, Artificial Sequence
  Synthetic
cuugagcuuaccguaauagcaa

SEQ ID NO: 22101 - RNA, 23 nt, Artificial Sequence
  Synthetic
gcuugagcuuaccguaauagcaa

SEQ ID NO: 22102 - RNA, 24 nt, Artificial Sequence
  Synthetic
ugcuugagcuuaccguaauagcaa

SEQ ID NO: 22103 - RNA, 18 nt, Artificial Sequence
  Synthetic
ggucaauuguauuagcaa

SEQ ID NO: 22104 - RNA, 19 nt, Artificial Sequence
  Synthetic
gggucaauuguauuagcaa

SEQ ID NO: 22105 - RNA, 20 nt, Artificial Sequence
  Synthetic
agggucaauuguauuagcaa

SEQ ID NO: 22106 - RNA, 21 nt, Artificial Sequence
  Synthetic
aagggucaauuguauuagcaa

SEQ ID NO: 22107 - RNA, 22 nt, Artificial Sequence
  Synthetic
uaagggucaauuguauuagcaa

SEQ ID NO: 22108 - RNA, 23 nt, Artificial Sequence
  Synthetic
uuaagggucaauuguauuagcaa

SEQ ID NO: 22109 - RNA, 24 nt, Artificial Sequence
  Synthetic
uuuaagggucaauuguauuagcaa

SEQ ID NO: 22110 - RNA, 18 nt, Artificial Sequence
  Synthetic
uuaguaaaaaaaaaucaa

SEQ ID NO: 22111 - RNA, 19 nt, Artificial Sequence
  Synthetic
auuaguaaaaaaaaaucaa

SEQ ID NO: 22112 - RNA, 20 nt, Artificial Sequence
  Synthetic
aauuaguaaaaaaaaaucaa

SEQ ID NO: 22113 - RNA, 21 nt, Artificial Sequence
  Synthetic
aaauuaguaaaaaaaaaucaa

SEQ ID NO: 22114 - RNA, 22 nt, Artificial Sequence
  Synthetic
aaaauuaguaaaaaaaaaucaa

SEQ ID NO: 22115 - RNA, 23 nt, Artificial Sequence
  Synthetic
caaaauuaguaaaaaaaaaucaa

SEQ ID NO: 22116 - RNA, 24 nt, Artificial Sequence
  Synthetic
acaaaauuaguaaaaaaaaaucaa

SEQ ID NO: 22117 - RNA, 18 nt, Artificial Sequence
  Synthetic
agcuaaaaugacaaucaa

SEQ ID NO: 22118 - RNA, 19 nt, Artificial Sequence
  Synthetic
cagcuaaaaugacaaucaa

SEQ ID NO: 22119 - RNA, 20 nt, Artificial Sequence
  Synthetic
acagcuaaaaugacaaucaa

SEQ ID NO: 22120 - RNA, 21 nt, Artificial Sequence
  Synthetic
cacagcuaaaaugacaaucaa

SEQ ID NO: 22121 - RNA, 22 nt, Artificial Sequence
  Synthetic
ccacagcuaaaaugacaaucaa

SEQ ID NO: 22122 - RNA, 23 nt, Artificial Sequence
  Synthetic
accacagcuaaaaugacaaucaa

SEQ ID NO: 22123 - RNA, 24 nt, Artificial Sequence
  Synthetic
uaccacagcuaaaaugacaaucaa

SEQ ID NO: 22124 - RNA, 18 nt, Artificial Sequence
  Synthetic
cugaagcggaaaggucaa

SEQ ID NO: 22125 - RNA, 19 nt, Artificial Sequence
  Synthetic
gcugaagcggaaaggucaa

SEQ ID NO: 22126 - RNA, 20 nt, Artificial Sequence
  Synthetic
ggcugaagcggaaaggucaa

SEQ ID NO: 22127 - RNA, 21 nt, Artificial Sequence
  Synthetic
aggcugaagcggaaaggucaa

SEQ ID NO: 22128 - RNA, 22 nt, Artificial Sequence
  Synthetic
gaggcugaagcggaaaggucaa

SEQ ID NO: 22129 - RNA, 23 nt, Artificial Sequence
  Synthetic
ggaggcugaagcggaaaggucaa

SEQ ID NO: 22130 - RNA, 24 nt, Artificial Sequence
  Synthetic
gggaggcugaagcggaaaggucaa

SEQ ID NO: 22131 - RNA, 18 nt, Artificial Sequence
  Synthetic
caccugaaauauauucaa

SEQ ID NO: 22132 - RNA, 19 nt, Artificial Sequence
  Synthetic
ucaccugaaauauauucaa

SEQ ID NO: 22133 - RNA, 20 nt, Artificial Sequence
  Synthetic
aucaccugaaauauauucaa

SEQ ID NO: 22134 - RNA, 21 nt, Artificial Sequence
  Synthetic
uaucaccugaaauauauucaa

SEQ ID NO: 22135 - RNA, 22 nt, Artificial Sequence
  Synthetic
auaucaccugaaauauauucaa

SEQ ID NO: 22136 - RNA, 23 nt, Artificial Sequence
  Synthetic
aauaucaccugaaauauauucaa

SEQ ID NO: 22137 - RNA, 24 nt, Artificial Sequence
  Synthetic
uaauaucaccugaaauauauucaa

SEQ ID NO: 22138 - RNA, 18 nt, Artificial Sequence
  Synthetic
aaaaaaaaaaaaaaagaa

SEQ ID NO: 22139 - RNA, 19 nt, Artificial Sequence
  Synthetic
aaaaaaaaaaaaaaaagaa

SEQ ID NO: 22140 - RNA, 20 nt, Artificial Sequence
  Synthetic
aaaaaaaaaaaaaaaaagaa

SEQ ID NO: 22141 - RNA, 21 nt, Artificial Sequence
  Synthetic
aaaaaaaaaaaaaaaaaagaa

SEQ ID NO: 22142 - RNA, 22 nt, Artificial Sequence
  Synthetic
aaaaaaaaaaaaaaaaaaagaa

SEQ ID NO: 22143 - RNA, 23 nt, Artificial Sequence
  Synthetic
aaaaaaaaaaaaaaaaaaaagaa

SEQ ID NO: 22144 - RNA, 24 nt, Artificial Sequence
  Synthetic
aaaaaaaaaaaaaaaaaaaaagaa

SEQ ID NO: 22145 - RNA, 18 nt, Artificial Sequence
  Synthetic
gaaauauauucaaaagaa

SEQ ID NO: 22146 - RNA, 19 nt, Artificial Sequence
  Synthetic
ugaaauauauucaaaagaa

SEQ ID NO: 22147 - RNA, 21 nt, Artificial Sequence
  Synthetic
ccugaaauauauucaaaagaa

SEQ ID NO: 22148 - RNA, 22 nt, Artificial Sequence
  Synthetic
accugaaauauauucaaaagaa

SEQ ID NO: 22149 - RNA, 23 nt, Artificial Sequence
  Synthetic
caccugaaauauauucaaaagaa

SEQ ID NO: 22150 - RNA, 24 nt, Artificial Sequence
  Synthetic
ucaccugaaauauauucaaaagaa

SEQ ID NO: 22151 - RNA, 18 nt, Artificial Sequence
  Synthetic
aaaaauacgauauaagaa

SEQ ID NO: 22152 - RNA, 19 nt, Artificial Sequence
  Synthetic
caaaaauacgauauaagaa

SEQ ID NO: 22153 - RNA, 20 nt, Artificial Sequence
  Synthetic
gcaaaaauacgauauaagaa

SEQ ID NO: 22154 - RNA, 21 nt, Artificial Sequence
  Synthetic
ugcaaaaauacgauauaagaa

SEQ ID NO: 22155 - RNA, 22 nt, Artificial Sequence
  Synthetic
uugcaaaaauacgauauaagaa

SEQ ID NO: 22156 - RNA, 23 nt, Artificial Sequence
  Synthetic
guugcaaaaauacgauauaagaa

SEQ ID NO: 22157 - RNA, 24 nt, Artificial Sequence
  Synthetic
aguugcaaaaauacgauauaagaa

SEQ ID NO: 22158 - RNA, 18 nt, Artificial Sequence
  Synthetic
ugagggaaugcaggagaa

SEQ ID NO: 22159 - RNA, 19 nt, Artificial Sequence
  Synthetic
augagggaaugcaggagaa

SEQ ID NO: 22160 - RNA, 21 nt, Artificial Sequence
  Synthetic
ggaugagggaaugcaggagaa

SEQ ID NO: 22161 - RNA, 22 nt, Artificial Sequence
  Synthetic
uggaugagggaaugcaggagaa

SEQ ID NO: 22162 - RNA, 23 nt, Artificial Sequence
  Synthetic
uuggaugagggaaugcaggagaa

SEQ ID NO: 22163 - RNA, 24 nt, Artificial Sequence
  Synthetic
guuggaugagggaaugcaggagaa

SEQ ID NO: 22164 - RNA, 18 nt, Artificial Sequence
  Synthetic
aauaaacaaacaaaggaa

SEQ ID NO: 22165 - RNA, 19 nt, Artificial Sequence
  Synthetic
aaauaaacaaacaaaggaa

SEQ ID NO: 22166 - RNA, 20 nt, Artificial Sequence
  Synthetic
caaauaaacaaacaaaggaa

SEQ ID NO: 22167 - RNA, 21 nt, Artificial Sequence
  Synthetic
ccaaauaaacaaacaaaggaa

SEQ ID NO: 22168 - RNA, 22 nt, Artificial Sequence
  Synthetic
accaaauaaacaaacaaaggaa

SEQ ID NO: 22169 - RNA, 23 nt, Artificial Sequence
  Synthetic
aaccaaauaaacaaacaaaggaa

SEQ ID NO: 22170 - RNA, 24 nt, Artificial Sequence
  Synthetic
aaaccaaauaaacaaacaaaggaa

SEQ ID NO: 22171 - RNA, 18 nt, Artificial Sequence
  Synthetic
aaaacugaguagaaggaa

SEQ ID NO: 22172 - RNA, 19 nt, Artificial Sequence
  Synthetic
uaaaacugaguagaaggaa

SEQ ID NO: 22173 - RNA, 21 nt, Artificial Sequence
  Synthetic
acuaaaacugaguagaaggaa

SEQ ID NO: 22174 - RNA, 22 nt, Artificial Sequence
  Synthetic
gacuaaaacugaguagaaggaa

SEQ ID NO: 22175 - RNA, 23 nt, Artificial Sequence
  Synthetic
ugacuaaaacugaguagaaggaa

SEQ ID NO: 22176 - RNA, 24 nt, Artificial Sequence
  Synthetic
cugacuaaaacugaguagaaggaa

SEQ ID NO: 22177 - RNA, 18 nt, Artificial Sequence
  Synthetic
uaaacagaaucaggggaa

SEQ ID NO: 22178 - RNA, 19 nt, Artificial Sequence
  Synthetic
uuaaacagaaucaggggaa

SEQ ID NO: 22179 - RNA, 20 nt, Artificial Sequence
  Synthetic
uuuaaacagaaucaggggaa

SEQ ID NO: 22180 - RNA, 21 nt, Artificial Sequence
  Synthetic
auuuaaacagaaucaggggaa

SEQ ID NO: 22181 - RNA, 22 nt, Artificial Sequence
  Synthetic
uauuuaaacagaaucaggggaa

SEQ ID NO: 22182 - RNA, 23 nt, Artificial Sequence
  Synthetic
cuauuuaaacagaaucaggggaa

SEQ ID NO: 22183 - RNA, 24 nt, Artificial Sequence
  Synthetic
gcuauuuaaacagaaucaggggaa

SEQ ID NO: 22184 - RNA, 18 nt, Artificial Sequence
  Synthetic
gcacuuugggaggcugaa

SEQ ID NO: 22185 - RNA, 19 nt, Artificial Sequence
  Synthetic
agcacuuugggaggcugaa

SEQ ID NO: 22186 - RNA, 20 nt, Artificial Sequence
  Synthetic
cagcacuuugggaggcugaa

SEQ ID NO: 22187 - RNA, 21 nt, Artificial Sequence
  Synthetic
ccagcacuuugggaggcugaa

SEQ ID NO: 22188 - RNA, 22 nt, Artificial Sequence
  Synthetic
cccagcacuuugggaggcugaa

SEQ ID NO: 22189 - RNA, 23 nt, Artificial Sequence
  Synthetic
acccagcacuuugggaggcugaa

SEQ ID NO: 22190 - RNA, 24 nt, Artificial Sequence
  Synthetic
aacccagcacuuugggaggcugaa

SEQ ID NO: 22191 - RNA, 18 nt, Artificial Sequence
  Synthetic
guacauuuaauaucugaa

SEQ ID NO: 22192 - RNA, 19 nt, Artificial Sequence
  Synthetic
uguacauuuaauaucugaa

SEQ ID NO: 22193 - RNA, 20 nt, Artificial Sequence
  Synthetic
auguacauuuaauaucugaa

SEQ ID NO: 22194 - RNA, 21 nt, Artificial Sequence
  Synthetic
gauguacauuuaauaucugaa

SEQ ID NO: 22195 - RNA, 22 nt, Artificial Sequence
  Synthetic
ugauguacauuuaauaucugaa

SEQ ID NO: 22196 - RNA, 23 nt, Artificial Sequence
  Synthetic
augauguacauuuaauaucugaa

SEQ ID NO: 22197 - RNA, 24 nt, Artificial Sequence
  Synthetic
aaugauguacauuuaauaucugaa

SEQ ID NO: 22198 - RNA, 18 nt, Artificial Sequence
  Synthetic
aaaaaaauucacaaauaa

SEQ ID NO: 22199 - RNA, 19 nt, Artificial Sequence
  Synthetic
aaaaaaaauucacaaauaa

SEQ ID NO: 22200 - RNA, 20 nt, Artificial Sequence
  Synthetic
gaaaaaaaauucacaaauaa

SEQ ID NO: 22201 - RNA, 21 nt, Artificial Sequence
  Synthetic
ugaaaaaaaauucacaaauaa

SEQ ID NO: 22202 - RNA, 22 nt, Artificial Sequence
  Synthetic
cugaaaaaaaauucacaaauaa

SEQ ID NO: 22203 - RNA, 23 nt, Artificial Sequence
  Synthetic
acugaaaaaaaauucacaaauaa

SEQ ID NO: 22204 - RNA, 24 nt, Artificial Sequence
  Synthetic
aacugaaaaaaaauucacaaauaa

SEQ ID NO: 22205 - RNA, 18 nt, Artificial Sequence
  Synthetic
ugaggcaaugaucaauaa

SEQ ID NO: 22206 - RNA, 19 nt, Artificial Sequence
  Synthetic
gugaggcaaugaucaauaa

SEQ ID NO: 22207 - RNA, 20 nt, Artificial Sequence
  Synthetic
agugaggcaaugaucaauaa

SEQ ID NO: 22208 - RNA, 21 nt, Artificial Sequence
  Synthetic
uagugaggcaaugaucaauaa

SEQ ID NO: 22209 - RNA, 22 nt, Artificial Sequence
  Synthetic
auagugaggcaaugaucaauaa

SEQ ID NO: 22210 - RNA, 23 nt, Artificial Sequence
  Synthetic
cauagugaggcaaugaucaauaa

SEQ ID NO: 22211 - RNA, 24 nt, Artificial Sequence
  Synthetic
ccauagugaggcaaugaucaauaa

SEQ ID NO: 22212 - RNA, 18 nt, Artificial Sequence
  Synthetic
agaaccuauaaggaauaa

SEQ ID NO: 22213 - RNA, 19 nt, Artificial Sequence
  Synthetic
cagaaccuauaaggaauaa

SEQ ID NO: 22214 - RNA, 20 nt, Artificial Sequence
  Synthetic
acagaaccuauaaggaauaa

SEQ ID NO: 22215 - RNA, 21 nt, Artificial Sequence
  Synthetic
uacagaaccuauaaggaauaa

SEQ ID NO: 22216 - RNA, 22 nt, Artificial Sequence
  Synthetic
uuacagaaccuauaaggaauaa

SEQ ID NO: 22217 - RNA, 23 nt, Artificial Sequence
  Synthetic
auuacagaaccuauaaggaauaa

SEQ ID NO: 22218 - RNA, 24 nt, Artificial Sequence
  Synthetic
aauuacagaaccuauaaggaauaa

SEQ ID NO: 22219 - RNA, 18 nt, Artificial Sequence
  Synthetic
acagugacuucauaauaa

SEQ ID NO: 22220 - RNA, 19 nt, Artificial Sequence
  Synthetic
uacagugacuucauaauaa

SEQ ID NO: 22221 - RNA, 21 nt, Artificial Sequence
  Synthetic
aauacagugacuucauaauaa

SEQ ID NO: 22222 - RNA, 22 nt, Artificial Sequence
  Synthetic
caauacagugacuucauaauaa

SEQ ID NO: 22223 - RNA, 23 nt, Artificial Sequence
  Synthetic
acaauacagugacuucauaauaa

SEQ ID NO: 22224 - RNA, 24 nt, Artificial Sequence
  Synthetic
gacaauacagugacuucauaauaa

SEQ ID NO: 22225 - RNA, 18 nt, Artificial Sequence
  Synthetic
uuacacuacuuauaauaa

SEQ ID NO: 22226 - RNA, 19 nt, Artificial Sequence
  Synthetic
uuuacacuacuuauaauaa

SEQ ID NO: 22227 - RNA, 20 nt, Artificial Sequence
  Synthetic
uuuuacacuacuuauaauaa

SEQ ID NO: 22228 - RNA, 21 nt, Artificial Sequence
  Synthetic
auuuuacacuacuuauaauaa

SEQ ID NO: 22229 - RNA, 22 nt, Artificial Sequence
  Synthetic
uauuuuacacuacuuauaauaa

SEQ ID NO: 22230 - RNA, 23 nt, Artificial Sequence
  Synthetic
auauuuuacacuacuuauaauaa

SEQ ID NO: 22231 - RNA, 24 nt, Artificial Sequence
  Synthetic
gauauuuuacacuacuuauaauaa

SEQ ID NO: 22232 - RNA, 18 nt, Artificial Sequence
  Synthetic
caaguagaaaaaagauaa

SEQ ID NO: 22233 - RNA, 19 nt, Artificial Sequence
  Synthetic
gcaaguagaaaaaagauaa

SEQ ID NO: 22234 - RNA, 20 nt, Artificial Sequence
  Synthetic
agcaaguagaaaaaagauaa

SEQ ID NO: 22235 - RNA, 21 nt, Artificial Sequence
  Synthetic
aagcaaguagaaaaaagauaa

SEQ ID NO: 22236 - RNA, 22 nt, Artificial Sequence
  Synthetic
aaagcaaguagaaaaaagauaa

SEQ ID NO: 22237 - RNA, 23 nt, Artificial Sequence
  Synthetic
caaagcaaguagaaaaaagauaa

SEQ ID NO: 22238 - RNA, 24 nt, Artificial Sequence
  Synthetic
gcaaagcaaguagaaaaaagauaa

SEQ ID NO: 22239 - RNA, 18 nt, Artificial Sequence
  Synthetic
auaauauacaagauauaa

SEQ ID NO: 22240 - RNA, 19 nt, Artificial Sequence
  Synthetic
aauaauauacaagauauaa

SEQ ID NO: 22241 - RNA, 20 nt, Artificial Sequence
  Synthetic
uaauaauauacaagauauaa

SEQ ID NO: 22242 - RNA, 21 nt, Artificial Sequence
  Synthetic
guaauaauauacaagauauaa

SEQ ID NO: 22243 - RNA, 22 nt, Artificial Sequence
  Synthetic
aguaauaauauacaagauauaa

SEQ ID NO: 22244 - RNA, 23 nt, Artificial Sequence
  Synthetic
uaguaauaauauacaagauauaa

SEQ ID NO: 22245 - RNA, 24 nt, Artificial Sequence
  Synthetic
cuaguaauaauauacaagauauaa

SEQ ID NO: 22246 - RNA, 18 nt, Artificial Sequence
  Synthetic
uaacuuuaugcuaacuaa

SEQ ID NO: 22247 - RNA, 19 nt, Artificial Sequence
  Synthetic
cuaacuuuaugcuaacuaa

SEQ ID NO: 22248 - RNA, 20 nt, Artificial Sequence
  Synthetic
ccuaacuuuaugcuaacuaa

SEQ ID NO: 22249 - RNA, 21 nt, Artificial Sequence
  Synthetic
accuaacuuuaugcuaacuaa

SEQ ID NO: 22250 - RNA, 22 nt, Artificial Sequence
  Synthetic
aaccuaacuuuaugcuaacuaa

SEQ ID NO: 22251 - RNA, 23 nt, Artificial Sequence
  Synthetic
aaaccuaacuuuaugcuaacuaa

SEQ ID NO: 22252 - RNA, 24 nt, Artificial Sequence
  Synthetic
caaaccuaacuuuaugcuaacuaa

SEQ ID NO: 22253 - RNA, 18 nt, Artificial Sequence
  Synthetic
aguaaaguaacaaaguaa

SEQ ID NO: 22254 - RNA, 19 nt, Artificial Sequence
  Synthetic
caguaaaguaacaaaguaa

SEQ ID NO: 22255 - RNA, 20 nt, Artificial Sequence
  Synthetic
ucaguaaaguaacaaaguaa

SEQ ID NO: 22256 - RNA, 21 nt, Artificial Sequence
  Synthetic
aucaguaaaguaacaaaguaa

SEQ ID NO: 22257 - RNA, 22 nt, Artificial Sequence
  Synthetic
uaucaguaaaguaacaaaguaa

SEQ ID NO: 22258 - RNA, 23 nt, Artificial Sequence
  Synthetic
uuaucaguaaaguaacaaaguaa

SEQ ID NO: 22259 - RNA, 24 nt, Artificial Sequence
  Synthetic
uuuaucaguaaaguaacaaaguaa

SEQ ID NO: 22260 - RNA, 18 nt, Artificial Sequence
  Synthetic
agcuaauaaauaaaguaa

SEQ ID NO: 22261 - RNA, 19 nt, Artificial Sequence
  Synthetic
aagcuaauaaauaaaguaa

SEQ ID NO: 22262 - RNA, 20 nt, Artificial Sequence
  Synthetic
aaagcuaauaaauaaaguaa

SEQ ID NO: 22263 - RNA, 21 nt, Artificial Sequence
  Synthetic
uaaagcuaauaaauaaaguaa

SEQ ID NO: 22264 - RNA, 22 nt, Artificial Sequence
  Synthetic
uuaaagcuaauaaauaaaguaa

SEQ ID NO: 22265 - RNA, 23 nt, Artificial Sequence
  Synthetic
uuuaaagcuaauaaauaaaguaa

SEQ ID NO: 22266 - RNA, 24 nt, Artificial Sequence
  Synthetic
auuuaaagcuaauaaauaaaguaa

SEQ ID NO: 22267 - RNA, 18 nt, Artificial Sequence
  Synthetic
uucuagaaaacaauguaa

SEQ ID NO: 22268 - RNA, 19 nt, Artificial Sequence
  Synthetic
uuucuagaaaacaauguaa

SEQ ID NO: 22269 - RNA, 21 nt, Artificial Sequence
  Synthetic
auuuucuagaaaacaauguaa

SEQ ID NO: 22270 - RNA, 22 nt, Artificial Sequence
  Synthetic
gauuuucuagaaaacaauguaa

SEQ ID NO: 22271 - RNA, 23 nt, Artificial Sequence
  Synthetic
agauuuucuagaaaacaauguaa

SEQ ID NO: 22272 - RNA, 24 nt, Artificial Sequence
  Synthetic
cagauuuucuagaaaacaauguaa

SEQ ID NO: 22273 - RNA, 18 nt, Artificial Sequence
  Synthetic
uauaaguguggaguguaa

SEQ ID NO: 22274 - RNA, 19 nt, Artificial Sequence
  Synthetic
guauaaguguggaguguaa

SEQ ID NO: 22275 - RNA, 21 nt, Artificial Sequence
  Synthetic
ggguauaaguguggaguguaa

SEQ ID NO: 22276 - RNA, 22 nt, Artificial Sequence
  Synthetic
gggguauaaguguggaguguaa

SEQ ID NO: 22277 - RNA, 23 nt, Artificial Sequence
  Synthetic
ugggguauaaguguggaguguaa

SEQ ID NO: 22278 - RNA, 24 nt, Artificial Sequence
  Synthetic
augggguauaaguguggaguguaa

SEQ ID NO: 22279 - RNA, 18 nt, Artificial Sequence
  Synthetic
ugaacucuaaucuauuaa

SEQ ID NO: 22280 - RNA, 19 nt, Artificial Sequence
  Synthetic
uugaacucuaaucuauuaa

SEQ ID NO: 22281 - RNA, 20 nt, Artificial Sequence
  Synthetic
auugaacucuaaucuauuaa

SEQ ID NO: 22282 - RNA, 21 nt, Artificial Sequence
  Synthetic
aauugaacucuaaucuauuaa

SEQ ID NO: 22283 - RNA, 22 nt, Artificial Sequence
  Synthetic
gaauugaacucuaaucuauuaa

SEQ ID NO: 22284 - RNA, 23 nt, Artificial Sequence
  Synthetic
ugaauugaacucuaaucuauuaa

SEQ ID NO: 22285 - RNA, 24 nt, Artificial Sequence
  Synthetic
cugaauugaacucuaaucuauuaa

SEQ ID NO: 22286 - RNA, 18 nt, Artificial Sequence
  Synthetic
gcuuaacccaucuauuaa

SEQ ID NO: 22287 - RNA, 19 nt, Artificial Sequence
  Synthetic
ggcuuaacccaucuauuaa

SEQ ID NO: 22288 - RNA, 20 nt, Artificial Sequence
  Synthetic
uggcuuaacccaucuauuaa

SEQ ID NO: 22289 - RNA, 21 nt, Artificial Sequence
  Synthetic
uuggcuuaacccaucuauuaa

SEQ ID NO: 22290 - RNA, 22 nt, Artificial Sequence
  Synthetic
guuggcuuaacccaucuauuaa

SEQ ID NO: 22291 - RNA, 23 nt, Artificial Sequence
  Synthetic
aguuggcuuaacccaucuauuaa

SEQ ID NO: 22292 - RNA, 24 nt, Artificial Sequence
  Synthetic
caguuggcuuaacccaucuauuaa

SEQ ID NO: 22293 - RNA, 18 nt, Artificial Sequence
  Synthetic
aauuuuccaauguauuaa

SEQ ID NO: 22294 - RNA, 19 nt, Artificial Sequence
  Synthetic
aaauuuuccaauguauuaa

SEQ ID NO: 22295 - RNA, 20 nt, Artificial Sequence
  Synthetic
aaaauuuuccaauguauuaa

SEQ ID NO: 22296 - RNA, 21 nt, Artificial Sequence
  Synthetic
aaaaauuuuccaauguauuaa

SEQ ID NO: 22297 - RNA, 22 nt, Artificial Sequence
  Synthetic
caaaaauuuuccaauguauuaa

SEQ ID NO: 22298 - RNA, 23 nt, Artificial Sequence
  Synthetic
ccaaaaauuuuccaauguauuaa

SEQ ID NO: 22299 - RNA, 24 nt, Artificial Sequence
  Synthetic
cccaaaaauuuuccaauguauuaa

SEQ ID NO: 22300 - RNA, 18 nt, Artificial Sequence
  Synthetic
agccuagaugauuauuaa

SEQ ID NO: 22301 - RNA, 19 nt, Artificial Sequence
  Synthetic
cagccuagaugauuauuaa

SEQ ID NO: 22302 - RNA, 20 nt, Artificial Sequence
  Synthetic
gcagccuagaugauuauuaa

SEQ ID NO: 22303 - RNA, 21 nt, Artificial Sequence
  Synthetic
ugcagccuagaugauuauuaa

SEQ ID NO: 22304 - RNA, 22 nt, Artificial Sequence
  Synthetic
uugcagccuagaugauuauuaa

SEQ ID NO: 22305 - RNA, 23 nt, Artificial Sequence
  Synthetic
uuugcagccuagaugauuauuaa

SEQ ID NO: 22306 - RNA, 24 nt, Artificial Sequence
  Synthetic
uuuugcagccuagaugauuauuaa

SEQ ID NO: 22307 - RNA, 18 nt, Artificial Sequence
  Synthetic
uauuuccucaauaguuaa

SEQ ID NO: 22308 - RNA, 19 nt, Artificial Sequence
  Synthetic
uuauuuccucaauaguuaa

SEQ ID NO: 22309 - RNA, 20 nt, Artificial Sequence
  Synthetic
uuuauuuccucaauaguuaa

SEQ ID NO: 22310 - RNA, 21 nt, Artificial Sequence
  Synthetic
auuuauuuccucaauaguuaa

SEQ ID NO: 22311 - RNA, 22 nt, Artificial Sequence
  Synthetic
aauuuauuuccucaauaguuaa

SEQ ID NO: 22312 - RNA, 23 nt, Artificial Sequence
  Synthetic
aaauuuauuuccucaauaguuaa

SEQ ID NO: 22313 - RNA, 24 nt, Artificial Sequence
  Synthetic
uaaauuuauuuccucaauaguuaa

SEQ ID NO: 22314 - RNA, 18 nt, Artificial Sequence
  Synthetic
caacauucuuggaaaaca

SEQ ID NO: 22315 - RNA, 19 nt, Artificial Sequence
  Synthetic
acaacauucuuggaaaaca

SEQ ID NO: 22316 - RNA, 20 nt, Artificial Sequence
  Synthetic
aacaacauucuuggaaaaca

SEQ ID NO: 22317 - RNA, 21 nt, Artificial Sequence
  Synthetic
gaacaacauucuuggaaaaca

SEQ ID NO: 22318 - RNA, 22 nt, Artificial Sequence
  Synthetic
ugaacaacauucuuggaaaaca

SEQ ID NO: 22319 - RNA, 23 nt, Artificial Sequence
  Synthetic
uugaacaacauucuuggaaaaca

SEQ ID NO: 22320 - RNA, 24 nt, Artificial Sequence
  Synthetic
uuugaacaacauucuuggaaaaca

SEQ ID NO: 22321 - RNA, 18 nt, Artificial Sequence
  Synthetic
aaugaaacaaauaaaaca

SEQ ID NO: 22322 - RNA, 19 nt, Artificial Sequence
  Synthetic
aaaugaaacaaauaaaaca

SEQ ID NO: 22323 - RNA, 20 nt, Artificial Sequence
  Synthetic
gaaaugaaacaaauaaaaca

SEQ ID NO: 22324 - RNA, 21 nt, Artificial Sequence
  Synthetic
agaaaugaaacaaauaaaaca

SEQ ID NO: 22325 - RNA, 22 nt, Artificial Sequence
  Synthetic
aagaaaugaaacaaauaaaaca

SEQ ID NO: 22326 - RNA, 23 nt, Artificial Sequence
  Synthetic
aaagaaaugaaacaaauaaaaca

SEQ ID NO: 22327 - RNA, 24 nt, Artificial Sequence
  Synthetic
aaaagaaaugaaacaaauaaaaca

SEQ ID NO: 22328 - RNA, 18 nt, Artificial Sequence
  Synthetic
aaaccaaauaaacaaaca

SEQ ID NO: 22329 - RNA, 19 nt, Artificial Sequence
  Synthetic
aaaaccaaauaaacaaaca

SEQ ID NO: 22330 - RNA, 20 nt, Artificial Sequence
  Synthetic
aaaaaccaaauaaacaaaca

SEQ ID NO: 22331 - RNA, 21 nt, Artificial Sequence
  Synthetic
uaaaaaccaaauaaacaaaca

SEQ ID NO: 22332 - RNA, 22 nt, Artificial Sequence
  Synthetic
guaaaaaccaaauaaacaaaca

SEQ ID NO: 22333 - RNA, 23 nt, Artificial Sequence
  Synthetic
aguaaaaaccaaauaaacaaaca

SEQ ID NO: 22334 - RNA, 24 nt, Artificial Sequence
  Synthetic
aaguaaaaaccaaauaaacaaaca

SEQ ID NO: 22335 - RNA, 18 nt, Artificial Sequence
  Synthetic
aaacuguaaauacaaaca

SEQ ID NO: 22336 - RNA, 19 nt, Artificial Sequence
  Synthetic
aaaacuguaaauacaaaca

SEQ ID NO: 22337 - RNA, 20 nt, Artificial Sequence
  Synthetic
uaaaacuguaaauacaaaca

SEQ ID NO: 22338 - RNA, 21 nt, Artificial Sequence
  Synthetic
uuaaaacuguaaauacaaaca

SEQ ID NO: 22339 - RNA, 22 nt, Artificial Sequence
  Synthetic
cuuaaaacuguaaauacaaaca

SEQ ID NO: 22340 - RNA, 23 nt, Artificial Sequence
  Synthetic
acuuaaaacuguaaauacaaaca

SEQ ID NO: 22341 - RNA, 24 nt, Artificial Sequence
  Synthetic
aacuuaaaacuguaaauacaaaca

SEQ ID NO: 22342 - RNA, 18 nt, Artificial Sequence
  Synthetic
gacaaucaaaugggaaca

SEQ ID NO: 22343 - RNA, 19 nt, Artificial Sequence
  Synthetic
ugacaaucaaaugggaaca

SEQ ID NO: 22344 - RNA, 21 nt, Artificial Sequence
  Synthetic
aaugacaaucaaaugggaaca

SEQ ID NO: 22345 - RNA, 22 nt, Artificial Sequence
  Synthetic
aaaugacaaucaaaugggaaca

SEQ ID NO: 22346 - RNA, 23 nt, Artificial Sequence
  Synthetic
aaaaugacaaucaaaugggaaca

SEQ ID NO: 22347 - RNA, 24 nt, Artificial Sequence
  Synthetic
uaaaaugacaaucaaaugggaaca

SEQ ID NO: 22348 - RNA, 18 nt, Artificial Sequence
  Synthetic
aaccuauaaggaauaaca

SEQ ID NO: 22349 - RNA, 19 nt, Artificial Sequence
  Synthetic
gaaccuauaaggaauaaca

SEQ ID NO: 22350 - RNA, 21 nt, Artificial Sequence
  Synthetic
cagaaccuauaaggaauaaca

SEQ ID NO: 22351 - RNA, 22 nt, Artificial Sequence
  Synthetic
acagaaccuauaaggaauaaca

SEQ ID NO: 22352 - RNA, 23 nt, Artificial Sequence
  Synthetic
uacagaaccuauaaggaauaaca

SEQ ID NO: 22353 - RNA, 24 nt, Artificial Sequence
  Synthetic
uuacagaaccuauaaggaauaaca

SEQ ID NO: 22354 - RNA, 18 nt, Artificial Sequence
  Synthetic
gagagagaacugcucaca

SEQ ID NO: 22355 - RNA, 19 nt, Artificial Sequence
  Synthetic
ggagagagaacugcucaca

SEQ ID NO: 22356 - RNA, 21 nt, Artificial Sequence
  Synthetic
cuggagagagaacugcucaca

SEQ ID NO: 22357 - RNA, 22 nt, Artificial Sequence
  Synthetic
acuggagagagaacugcucaca

SEQ ID NO: 22358 - RNA, 23 nt, Artificial Sequence
  Synthetic
uacuggagagagaacugcucaca

SEQ ID NO: 22359 - RNA, 24 nt, Artificial Sequence
  Synthetic
uuacuggagagagaacugcucaca

SEQ ID NO: 22360 - RNA, 18 nt, Artificial Sequence
  Synthetic
uuuacaauucuuauuaca

SEQ ID NO: 22361 - RNA, 19 nt, Artificial Sequence
  Synthetic
uuuuacaauucuuauuaca

SEQ ID NO: 22362 - RNA, 21 nt, Artificial Sequence
  Synthetic
aauuuuacaauucuuauuaca

SEQ ID NO: 22363 - RNA, 22 nt, Artificial Sequence
  Synthetic
aaauuuuacaauucuuauuaca

SEQ ID NO: 22364 - RNA, 23 nt, Artificial Sequence
  Synthetic
uaaauuuuacaauucuuauuaca

SEQ ID NO: 22365 - RNA, 24 nt, Artificial Sequence
  Synthetic
guaaauuuuacaauucuuauuaca

SEQ ID NO: 22366 - RNA, 18 nt, Artificial Sequence
  Synthetic
caggaguucaagguuaca

SEQ ID NO: 22367 - RNA, 19 nt, Artificial Sequence
  Synthetic
ccaggaguucaagguuaca

SEQ ID NO: 22368 - RNA, 20 nt, Artificial Sequence
  Synthetic
cccaggaguucaagguuaca

SEQ ID NO: 22369 - RNA, 21 nt, Artificial Sequence
  Synthetic
gcccaggaguucaagguuaca

SEQ ID NO: 22370 - RNA, 22 nt, Artificial Sequence
  Synthetic
agcccaggaguucaagguuaca

SEQ ID NO: 22371 - RNA, 23 nt, Artificial Sequence
  Synthetic
gagcccaggaguucaagguuaca

SEQ ID NO: 22372 - RNA, 24 nt, Artificial Sequence
  Synthetic
ugagcccaggaguucaagguuaca

SEQ ID NO: 22373 - RNA, 18 nt, Artificial Sequence
  Synthetic
ugagcuaugaucacacca

SEQ ID NO: 22374 - RNA, 19 nt, Artificial Sequence
  Synthetic
gugagcuaugaucacacca

SEQ ID NO: 22375 - RNA, 20 nt, Artificial Sequence
  Synthetic
agugagcuaugaucacacca

SEQ ID NO: 22376 - RNA, 21 nt, Artificial Sequence
  Synthetic
cagugagcuaugaucacacca

SEQ ID NO: 22377 - RNA, 22 nt, Artificial Sequence
  Synthetic
acagugagcuaugaucacacca

SEQ ID NO: 22378 - RNA, 23 nt, Artificial Sequence
  Synthetic
uacagugagcuaugaucacacca

SEQ ID NO: 22379 - RNA, 24 nt, Artificial Sequence
  Synthetic
uuacagugagcuaugaucacacca

SEQ ID NO: 22380 - RNA, 18 nt, Artificial Sequence
  Synthetic
ggccucuaaucucaccca

SEQ ID NO: 22381 - RNA, 19 nt, Artificial Sequence
  Synthetic
uggccucuaaucucaccca

SEQ ID NO: 22382 - RNA, 20 nt, Artificial Sequence
  Synthetic
guggccucuaaucucaccca

SEQ ID NO: 22383 - RNA, 21 nt, Artificial Sequence
  Synthetic
aguggccucuaaucucaccca

SEQ ID NO: 22384 - RNA, 22 nt, Artificial Sequence
  Synthetic
caguggccucuaaucucaccca

SEQ ID NO: 22385 - RNA, 23 nt, Artificial Sequence
  Synthetic
ccaguggccucuaaucucaccca

SEQ ID NO: 22386 - RNA, 24 nt, Artificial Sequence
  Synthetic
uccaguggccucuaaucucaccca

SEQ ID NO: 22387 - RNA, 18 nt, Artificial Sequence
  Synthetic
cagcuaaaguauuaccca

SEQ ID NO: 22388 - RNA, 19 nt, Artificial Sequence
  Synthetic
acagcuaaaguauuaccca

SEQ ID NO: 22389 - RNA, 20 nt, Artificial Sequence
  Synthetic
uacagcuaaaguauuaccca

SEQ ID NO: 22390 - RNA, 21 nt, Artificial Sequence
  Synthetic
auacagcuaaaguauuaccca

SEQ ID NO: 22391 - RNA, 22 nt, Artificial Sequence
  Synthetic
uauacagcuaaaguauuaccca

SEQ ID NO: 22392 - RNA, 23 nt, Artificial Sequence
  Synthetic
auauacagcuaaaguauuaccca

SEQ ID NO: 22393 - RNA, 24 nt, Artificial Sequence
  Synthetic
aauauacagcuaaaguauuaccca

SEQ ID NO: 22394 - RNA, 18 nt, Artificial Sequence
  Synthetic
aguguuuaaauauuccca

SEQ ID NO: 22395 - RNA, 19 nt, Artificial Sequence
  Synthetic
aaguguuuaaauauuccca

SEQ ID NO: 22396 - RNA, 21 nt, Artificial Sequence
  Synthetic
agaaguguuuaaauauuccca

SEQ ID NO: 22397 - RNA, 22 nt, Artificial Sequence
  Synthetic
cagaaguguuuaaauauuccca

SEQ ID NO: 22398 - RNA, 23 nt, Artificial Sequence
  Synthetic
ucagaaguguuuaaauauuccca

SEQ ID NO: 22399 - RNA, 24 nt, Artificial Sequence
  Synthetic
cucagaaguguuuaaauauuccca

SEQ ID NO: 22400 - RNA, 18 nt, Artificial Sequence
  Synthetic
uaguauuaaguauagcca

SEQ ID NO: 22401 - RNA, 19 nt, Artificial Sequence
  Synthetic
uuaguauuaaguauagcca

SEQ ID NO: 22402 - RNA, 20 nt, Artificial Sequence
  Synthetic
auuaguauuaaguauagcca

SEQ ID NO: 22403 - RNA, 21 nt, Artificial Sequence
  Synthetic
uauuaguauuaaguauagcca

SEQ ID NO: 22404 - RNA, 22 nt, Artificial Sequence
  Synthetic
uuauuaguauuaaguauagcca

SEQ ID NO: 22405 - RNA, 23 nt, Artificial Sequence
  Synthetic
guuauuaguauuaaguauagcca

SEQ ID NO: 22406 - RNA, 24 nt, Artificial Sequence
  Synthetic
aguuauuaguauuaaguauagcca

SEQ ID NO: 22407 - RNA, 18 nt, Artificial Sequence
  Synthetic
ugaguauacuuuaugcca

SEQ ID NO: 22408 - RNA, 19 nt, Artificial Sequence
  Synthetic
gugaguauacuuuaugcca

SEQ ID NO: 22409 - RNA, 20 nt, Artificial Sequence
  Synthetic
ugugaguauacuuuaugcca

SEQ ID NO: 22410 - RNA, 21 nt, Artificial Sequence
  Synthetic
augugaguauacuuuaugcca

SEQ ID NO: 22411 - RNA, 22 nt, Artificial Sequence
  Synthetic
uaugugaguauacuuuaugcca

SEQ ID NO: 22412 - RNA, 23 nt, Artificial Sequence
  Synthetic
cuaugugaguauacuuuaugcca

SEQ ID NO: 22413 - RNA, 24 nt, Artificial Sequence
  Synthetic
acuaugugaguauacuuuaugcca

SEQ ID NO: 22414 - RNA, 18 nt, Artificial Sequence
  Synthetic
gaaggaaaggagguagca

SEQ ID NO: 22415 - RNA, 19 nt, Artificial Sequence
  Synthetic
agaaggaaaggagguagca

SEQ ID NO: 22416 - RNA, 20 nt, Artificial Sequence
  Synthetic
uagaaggaaaggagguagca

SEQ ID NO: 22417 - RNA, 21 nt, Artificial Sequence
  Synthetic
guagaaggaaaggagguagca

SEQ ID NO: 22418 - RNA, 22 nt, Artificial Sequence
  Synthetic
aguagaaggaaaggagguagca

SEQ ID NO: 22419 - RNA, 23 nt, Artificial Sequence
  Synthetic
gaguagaaggaaaggagguagca

SEQ ID NO: 22420 - RNA, 24 nt, Artificial Sequence
  Synthetic
ugaguagaaggaaaggagguagca

SEQ ID NO: 22421 - RNA, 18 nt, Artificial Sequence
  Synthetic
uucaacauaugaauggca

SEQ ID NO: 22422 - RNA, 19 nt, Artificial Sequence
  Synthetic
uuucaacauaugaauggca

SEQ ID NO: 22423 - RNA, 21 nt, Artificial Sequence
  Synthetic
gauuucaacauaugaauggca

SEQ ID NO: 22424 - RNA, 22 nt, Artificial Sequence
  Synthetic
ggauuucaacauaugaauggca

SEQ ID NO: 22425 - RNA, 23 nt, Artificial Sequence
  Synthetic
aggauuucaacauaugaauggca

SEQ ID NO: 22426 - RNA, 24 nt, Artificial Sequence
  Synthetic
uaggauuucaacauaugaauggca

SEQ ID NO: 22427 - RNA, 18 nt, Artificial Sequence
  Synthetic
cgggaggcggagcuugca

SEQ ID NO: 22428 - RNA, 19 nt, Artificial Sequence
  Synthetic
ccgggaggcggagcuugca

SEQ ID NO: 22429 - RNA, 20 nt, Artificial Sequence
  Synthetic
cccgggaggcggagcuugca

SEQ ID NO: 22430 - RNA, 21 nt, Artificial Sequence
  Synthetic
acccgggaggcggagcuugca

SEQ ID NO: 22431 - RNA, 22 nt, Artificial Sequence
  Synthetic
aacccgggaggcggagcuugca

SEQ ID NO: 22432 - RNA, 23 nt, Artificial Sequence
  Synthetic
gaacccgggaggcggagcuugca

SEQ ID NO: 22433 - RNA, 24 nt, Artificial Sequence
  Synthetic
ugaacccgggaggcggagcuugca

SEQ ID NO: 22434 - RNA, 18 nt, Artificial Sequence
  Synthetic
cgggaggcagagguugca

SEQ ID NO: 22435 - RNA, 19 nt, Artificial Sequence
  Synthetic
ccgggaggcagagguugca

SEQ ID NO: 22436 - RNA, 20 nt, Artificial Sequence
  Synthetic
cccgggaggcagagguugca

SEQ ID NO: 22437 - RNA, 21 nt, Artificial Sequence
  Synthetic
gcccgggaggcagagguugca

SEQ ID NO: 22438 - RNA, 22 nt, Artificial Sequence
  Synthetic
agcccgggaggcagagguugca

SEQ ID NO: 22439 - RNA, 23 nt, Artificial Sequence
  Synthetic
gagcccgggaggcagagguugca

SEQ ID NO: 22440 - RNA, 24 nt, Artificial Sequence
  Synthetic
ugagcccgggaggcagagguugca

SEQ ID NO: 22441 - RNA, 18 nt, Artificial Sequence
  Synthetic
gcuauuuaaacagaauca

SEQ ID NO: 22442 - RNA, 19 nt, Artificial Sequence
  Synthetic
ugcuauuuaaacagaauca

SEQ ID NO: 22443 - RNA, 21 nt, Artificial Sequence
  Synthetic
agugcuauuuaaacagaauca

SEQ ID NO: 22444 - RNA, 22 nt, Artificial Sequence
  Synthetic
cagugcuauuuaaacagaauca

SEQ ID NO: 22445 - RNA, 23 nt, Artificial Sequence
  Synthetic
ccagugcuauuuaaacagaauca

SEQ ID NO: 22446 - RNA, 24 nt, Artificial Sequence
  Synthetic
uccagugcuauuuaaacagaauca

SEQ ID NO: 22447 - RNA, 18 nt, Artificial Sequence
  Synthetic
aguacaaaaggacuauca

SEQ ID NO: 22448 - RNA, 19 nt, Artificial Sequence
  Synthetic
uaguacaaaaggacuauca

SEQ ID NO: 22449 - RNA, 20 nt, Artificial Sequence
  Synthetic
auaguacaaaaggacuauca

SEQ ID NO: 22450 - RNA, 21 nt, Artificial Sequence
  Synthetic
gauaguacaaaaggacuauca

SEQ ID NO: 22451 - RNA, 22 nt, Artificial Sequence
  Synthetic
ugauaguacaaaaggacuauca

SEQ ID NO: 22452 - RNA, 23 nt, Artificial Sequence
  Synthetic
augauaguacaaaaggacuauca

SEQ ID NO: 22453 - RNA, 24 nt, Artificial Sequence
  Synthetic
gaugauaguacaaaaggacuauca

SEQ ID NO: 22454 - RNA, 18 nt, Artificial Sequence
  Synthetic
uuaggauaucuuagguca

SEQ ID NO: 22455 - RNA, 19 nt, Artificial Sequence
  Synthetic
cuuaggauaucuuagguca

SEQ ID NO: 22456 - RNA, 20 nt, Artificial Sequence
  Synthetic
ccuuaggauaucuuagguca

SEQ ID NO: 22457 - RNA, 21 nt, Artificial Sequence
  Synthetic
cccuuaggauaucuuagguca

SEQ ID NO: 22458 - RNA, 22 nt, Artificial Sequence
  Synthetic
ucccuuaggauaucuuagguca

SEQ ID NO: 22459 - RNA, 23 nt, Artificial Sequence
  Synthetic
uucccuuaggauaucuuagguca

SEQ ID NO: 22460 - RNA, 24 nt, Artificial Sequence
  Synthetic
uuucccuuaggauaucuuagguca

SEQ ID NO: 22461 - RNA, 18 nt, Artificial Sequence
  Synthetic
uauucuuuuaugugguca

SEQ ID NO: 22462 - RNA, 19 nt, Artificial Sequence
  Synthetic
auauucuuuuaugugguca

SEQ ID NO: 22463 - RNA, 20 nt, Artificial Sequence
  Synthetic
uauauucuuuuaugugguca

SEQ ID NO: 22464 - RNA, 21 nt, Artificial Sequence
  Synthetic
auauauucuuuuaugugguca

SEQ ID NO: 22465 - RNA, 22 nt, Artificial Sequence
  Synthetic
aauauauucuuuuaugugguca

SEQ ID NO: 22466 - RNA, 23 nt, Artificial Sequence
  Synthetic
gaauauauucuuuuaugugguca

SEQ ID NO: 22467 - RNA, 24 nt, Artificial Sequence
  Synthetic
cgaauauauucuuuuaugugguca

SEQ ID NO: 22468 - RNA, 18 nt, Artificial Sequence
  Synthetic
cuucacuaaaauaauuca

SEQ ID NO: 22469 - RNA, 19 nt, Artificial Sequence
  Synthetic
gcuucacuaaaauaauuca

SEQ ID NO: 22470 - RNA, 21 nt, Artificial Sequence
  Synthetic
uugcuucacuaaaauaauuca

SEQ ID NO: 22471 - RNA, 22 nt, Artificial Sequence
  Synthetic
auugcuucacuaaaauaauuca

SEQ ID NO: 22472 - RNA, 23 nt, Artificial Sequence
  Synthetic
uauugcuucacuaaaauaauuca

SEQ ID NO: 22473 - RNA, 24 nt, Artificial Sequence
  Synthetic
auauugcuucacuaaaauaauuca

SEQ ID NO: 22474 - RNA, 18 nt, Artificial Sequence
  Synthetic
aaucuaaaagcuaauuca

SEQ ID NO: 22475 - RNA, 19 nt, Artificial Sequence
  Synthetic
aaaucuaaaagcuaauuca

SEQ ID NO: 22476 - RNA, 21 nt, Artificial Sequence
  Synthetic
guaaaucuaaaagcuaauuca

SEQ ID NO: 22477 - RNA, 22 nt, Artificial Sequence
  Synthetic
aguaaaucuaaaagcuaauuca

SEQ ID NO: 22478 - RNA, 23 nt, Artificial Sequence
  Synthetic
aaguaaaucuaaaagcuaauuca

SEQ ID NO: 22479 - RNA, 24 nt, Artificial Sequence
  Synthetic
uaaguaaaucuaaaagcuaauuca

SEQ ID NO: 22480 - RNA, 18 nt, Artificial Sequence
  Synthetic
caggcccaaauacauuca

SEQ ID NO: 22481 - RNA, 19 nt, Artificial Sequence
  Synthetic
gcaggcccaaauacauuca

SEQ ID NO: 22482 - RNA, 20 nt, Artificial Sequence
  Synthetic
ugcaggcccaaauacauuca

SEQ ID NO: 22483 - RNA, 21 nt, Artificial Sequence
  Synthetic
augcaggcccaaauacauuca

SEQ ID NO: 22484 - RNA, 22 nt, Artificial Sequence
  Synthetic
uaugcaggcccaaauacauuca

SEQ ID NO: 22485 - RNA, 23 nt, Artificial Sequence
  Synthetic
auaugcaggcccaaauacauuca

SEQ ID NO: 22486 - RNA, 24 nt, Artificial Sequence
  Synthetic
cauaugcaggcccaaauacauuca

SEQ ID NO: 22487 - RNA, 18 nt, Artificial Sequence
  Synthetic
gaauugguacaaauuuca

SEQ ID NO: 22488 - RNA, 19 nt, Artificial Sequence
  Synthetic
cgaauugguacaaauuuca

SEQ ID NO: 22489 - RNA, 21 nt, Artificial Sequence
  Synthetic
uacgaauugguacaaauuuca

SEQ ID NO: 22490 - RNA, 22 nt, Artificial Sequence
  Synthetic
guacgaauugguacaaauuuca

SEQ ID NO: 22491 - RNA, 23 nt, Artificial Sequence
  Synthetic
aguacgaauugguacaaauuuca

SEQ ID NO: 22492 - RNA, 24 nt, Artificial Sequence
  Synthetic
gaguacgaauugguacaaauuuca

SEQ ID NO: 22493 - RNA, 18 nt, Artificial Sequence
  Synthetic
ugaaauauauucaaaaga

SEQ ID NO: 22494 - RNA, 19 nt, Artificial Sequence
  Synthetic
cugaaauauauucaaaaga

SEQ ID NO: 22495 - RNA, 20 nt, Artificial Sequence
  Synthetic
ccugaaauauauucaaaaga

SEQ ID NO: 22496 - RNA, 21 nt, Artificial Sequence
  Synthetic
accugaaauauauucaaaaga

SEQ ID NO: 22497 - RNA, 22 nt, Artificial Sequence
  Synthetic
caccugaaauauauucaaaaga

SEQ ID NO: 22498 - RNA, 23 nt, Artificial Sequence
  Synthetic
ucaccugaaauauauucaaaaga

SEQ ID NO: 22499 - RNA, 24 nt, Artificial Sequence
  Synthetic
aucaccugaaauauauucaaaaga

SEQ ID NO: 22500 - RNA, 18 nt, Artificial Sequence
  Synthetic
gaugagagacaguaaaga

SEQ ID NO: 22501 - RNA, 19 nt, Artificial Sequence
  Synthetic
agaugagagacaguaaaga

SEQ ID NO: 22502 - RNA, 20 nt, Artificial Sequence
  Synthetic
cagaugagagacaguaaaga

SEQ ID NO: 22503 - RNA, 21 nt, Artificial Sequence
  Synthetic
acagaugagagacaguaaaga

SEQ ID NO: 22504 - RNA, 22 nt, Artificial Sequence
  Synthetic
gacagaugagagacaguaaaga

SEQ ID NO: 22505 - RNA, 23 nt, Artificial Sequence
  Synthetic
ggacagaugagagacaguaaaga

SEQ ID NO: 22506 - RNA, 24 nt, Artificial Sequence
  Synthetic
uggacagaugagagacaguaaaga

SEQ ID NO: 22507 - RNA, 18 nt, Artificial Sequence
  Synthetic
aauaauaacauuuuaaga

SEQ ID NO: 22508 - RNA, 19 nt, Artificial Sequence
  Synthetic
aaauaauaacauuuuaaga

SEQ ID NO: 22509 - RNA, 20 nt, Artificial Sequence
  Synthetic
aaaauaauaacauuuuaaga

SEQ ID NO: 22510 - RNA, 21 nt, Artificial Sequence
  Synthetic
aaaaauaauaacauuuuaaga

SEQ ID NO: 22511 - RNA, 22 nt, Artificial Sequence
  Synthetic
gaaaaauaauaacauuuuaaga

SEQ ID NO: 22512 - RNA, 23 nt, Artificial Sequence
  Synthetic
agaaaaauaauaacauuuuaaga

SEQ ID NO: 22513 - RNA, 24 nt, Artificial Sequence
  Synthetic
aagaaaaauaauaacauuuuaaga

SEQ ID NO: 22514 - RNA, 18 nt, Artificial Sequence
  Synthetic
uccagccugggcgacaga

SEQ ID NO: 22515 - RNA, 19 nt, Artificial Sequence
  Synthetic
cuccagccugggcgacaga

SEQ ID NO: 22516 - RNA, 20 nt, Artificial Sequence
  Synthetic
acuccagccugggcgacaga

SEQ ID NO: 22517 - RNA, 21 nt, Artificial Sequence
  Synthetic
cacuccagccugggcgacaga

SEQ ID NO: 22518 - RNA, 22 nt, Artificial Sequence
  Synthetic
gcacuccagccugggcgacaga

SEQ ID NO: 22519 - RNA, 23 nt, Artificial Sequence
  Synthetic
ugcacuccagccugggcgacaga

SEQ ID NO: 22520 - RNA, 24 nt, Artificial Sequence
  Synthetic
cugcacuccagccugggcgacaga

SEQ ID NO: 22521 - RNA, 18 nt, Artificial Sequence
  Synthetic
guguucucacauggcaga

SEQ ID NO: 22522 - RNA, 19 nt, Artificial Sequence
  Synthetic
uguguucucacauggcaga

SEQ ID NO: 22523 - RNA, 20 nt, Artificial Sequence
  Synthetic
cuguguucucacauggcaga

SEQ ID NO: 22524 - RNA, 21 nt, Artificial Sequence
  Synthetic
gcuguguucucacauggcaga

SEQ ID NO: 22525 - RNA, 22 nt, Artificial Sequence
  Synthetic
ugcuguguucucacauggcaga

SEQ ID NO: 22526 - RNA, 23 nt, Artificial Sequence
  Synthetic
cugcuguguucucacauggcaga

SEQ ID NO: 22527 - RNA, 24 nt, Artificial Sequence
  Synthetic
ccugcuguguucucacauggcaga

SEQ ID NO: 22528 - RNA, 18 nt, Artificial Sequence
  Synthetic
ugaauggcaggggagaga

SEQ ID NO: 22529 - RNA, 19 nt, Artificial Sequence
  Synthetic
augaauggcaggggagaga

SEQ ID NO: 22530 - RNA, 20 nt, Artificial Sequence
  Synthetic
uaugaauggcaggggagaga

SEQ ID NO: 22531 - RNA, 21 nt, Artificial Sequence
  Synthetic
auaugaauggcaggggagaga

SEQ ID NO: 22532 - RNA, 22 nt, Artificial Sequence
  Synthetic
cauaugaauggcaggggagaga

SEQ ID NO: 22533 - RNA, 23 nt, Artificial Sequence
  Synthetic
acauaugaauggcaggggagaga

SEQ ID NO: 22534 - RNA, 24 nt, Artificial Sequence
  Synthetic
aacauaugaauggcaggggagaga

SEQ ID NO: 22535 - RNA, 18 nt, Artificial Sequence
  Synthetic
augagggaaugcaggaga

SEQ ID NO: 22536 - RNA, 19 nt, Artificial Sequence
  Synthetic
gaugagggaaugcaggaga

SEQ ID NO: 22537 - RNA, 20 nt, Artificial Sequence
  Synthetic
ggaugagggaaugcaggaga

SEQ ID NO: 22538 - RNA, 21 nt, Artificial Sequence
  Synthetic
uggaugagggaaugcaggaga

SEQ ID NO: 22539 - RNA, 22 nt, Artificial Sequence
  Synthetic
uuggaugagggaaugcaggaga

SEQ ID NO: 22540 - RNA, 23 nt, Artificial Sequence
  Synthetic
guuggaugagggaaugcaggaga

SEQ ID NO: 22541 - RNA, 24 nt, Artificial Sequence
  Synthetic
gguuggaugagggaaugcaggaga

SEQ ID NO: 22542 - RNA, 18 nt, Artificial Sequence
  Synthetic
gaucacgaggucaggaga

SEQ ID NO: 22543 - RNA, 19 nt, Artificial Sequence
  Synthetic
ggaucacgaggucaggaga

SEQ ID NO: 22544 - RNA, 20 nt, Artificial Sequence
  Synthetic
cggaucacgaggucaggaga

SEQ ID NO: 22545 - RNA, 21 nt, Artificial Sequence
  Synthetic
gcggaucacgaggucaggaga

SEQ ID NO: 22546 - RNA, 22 nt, Artificial Sequence
  Synthetic
ggcggaucacgaggucaggaga

SEQ ID NO: 22547 - RNA, 23 nt, Artificial Sequence
  Synthetic
gggcggaucacgaggucaggaga

SEQ ID NO: 22548 - RNA, 24 nt, Artificial Sequence
  Synthetic
cgggcggaucacgaggucaggaga

SEQ ID NO: 22549 - RNA, 18 nt, Artificial Sequence
  Synthetic
uaggaaaacaacuggaga

SEQ ID NO: 22550 - RNA, 19 nt, Artificial Sequence
  Synthetic
guaggaaaacaacuggaga

SEQ ID NO: 22551 - RNA, 20 nt, Artificial Sequence
  Synthetic
uguaggaaaacaacuggaga

SEQ ID NO: 22552 - RNA, 21 nt, Artificial Sequence
  Synthetic
auguaggaaaacaacuggaga

SEQ ID NO: 22553 - RNA, 22 nt, Artificial Sequence
  Synthetic
uauguaggaaaacaacuggaga

SEQ ID NO: 22554 - RNA, 23 nt, Artificial Sequence
  Synthetic
guauguaggaaaacaacuggaga

SEQ ID NO: 22555 - RNA, 24 nt, Artificial Sequence
  Synthetic
cguauguaggaaaacaacuggaga

SEQ ID NO: 22556 - RNA, 18 nt, Artificial Sequence
  Synthetic
uaugcaauuuacuggaga

SEQ ID NO: 22557 - RNA, 19 nt, Artificial Sequence
  Synthetic
auaugcaauuuacuggaga

SEQ ID NO: 22558 - RNA, 20 nt, Artificial Sequence
  Synthetic
aauaugcaauuuacuggaga

SEQ ID NO: 22559 - RNA, 21 nt, Artificial Sequence
  Synthetic
caauaugcaauuuacuggaga

SEQ ID NO: 22560 - RNA, 22 nt, Artificial Sequence
  Synthetic
gcaauaugcaauuuacuggaga

SEQ ID NO: 22561 - RNA, 23 nt, Artificial Sequence
  Synthetic
ugcaauaugcaauuuacuggaga

SEQ ID NO: 22562 - RNA, 24 nt, Artificial Sequence
  Synthetic
cugcaauaugcaauuuacuggaga

SEQ ID NO: 22563 - RNA, 18 nt, Artificial Sequence
  Synthetic
gaacuagagucacauaga

SEQ ID NO: 22564 - RNA, 19 nt, Artificial Sequence
  Synthetic
ugaacuagagucacauaga

SEQ ID NO: 22565 - RNA, 20 nt, Artificial Sequence
  Synthetic
gugaacuagagucacauaga

SEQ ID NO: 22566 - RNA, 21 nt, Artificial Sequence
  Synthetic
agugaacuagagucacauaga

SEQ ID NO: 22567 - RNA, 22 nt, Artificial Sequence
  Synthetic
uagugaacuagagucacauaga

SEQ ID NO: 22568 - RNA, 23 nt, Artificial Sequence
  Synthetic
uuagugaacuagagucacauaga

SEQ ID NO: 22569 - RNA, 24 nt, Artificial Sequence
  Synthetic
auuagugaacuagagucacauaga

SEQ ID NO: 22570 - RNA, 18 nt, Artificial Sequence
  Synthetic
auugauuauauauauaga

SEQ ID NO: 22571 - RNA, 19 nt, Artificial Sequence
  Synthetic
uauugauuauauauauaga

SEQ ID NO: 22572 - RNA, 20 nt, Artificial Sequence
  Synthetic
auauugauuauauauauaga

SEQ ID NO: 22573 - RNA, 21 nt, Artificial Sequence
  Synthetic
uauauugauuauauauauaga

SEQ ID NO: 22574 - RNA, 22 nt, Artificial Sequence
  Synthetic
guauauugauuauauauauaga

SEQ ID NO: 22575 - RNA, 23 nt, Artificial Sequence
  Synthetic
uguauauugauuauauauauaga

SEQ ID NO: 22576 - RNA, 24 nt, Artificial Sequence
  Synthetic
auguauauugauuauauauauaga

SEQ ID NO: 22577 - RNA, 18 nt, Artificial Sequence
  Synthetic
aggaucacuuuauauaga

SEQ ID NO: 22578 - RNA, 19 nt, Artificial Sequence
  Synthetic
uaggaucacuuuauauaga

SEQ ID NO: 22579 - RNA, 20 nt, Artificial Sequence
  Synthetic
cuaggaucacuuuauauaga

SEQ ID NO: 22580 - RNA, 21 nt, Artificial Sequence
  Synthetic
ucuaggaucacuuuauauaga

SEQ ID NO: 22581 - RNA, 22 nt, Artificial Sequence
  Synthetic
uucuaggaucacuuuauauaga

SEQ ID NO: 22582 - RNA, 23 nt, Artificial Sequence
  Synthetic
auucuaggaucacuuuauauaga

SEQ ID NO: 22583 - RNA, 24 nt, Artificial Sequence
  Synthetic
gauucuaggaucacuuuauauaga

SEQ ID NO: 22584 - RNA, 18 nt, Artificial Sequence
  Synthetic
ugacuaaaacugaguaga

SEQ ID NO: 22585 - RNA, 19 nt, Artificial Sequence
  Synthetic
cugacuaaaacugaguaga

SEQ ID NO: 22586 - RNA, 21 nt, Artificial Sequence
  Synthetic
uacugacuaaaacugaguaga

SEQ ID NO: 22587 - RNA, 22 nt, Artificial Sequence
  Synthetic
cuacugacuaaaacugaguaga

SEQ ID NO: 22588 - RNA, 23 nt, Artificial Sequence
  Synthetic
acuacugacuaaaacugaguaga

SEQ ID NO: 22589 - RNA, 24 nt, Artificial Sequence
  Synthetic
uacuacugacuaaaacugaguaga

SEQ ID NO: 22590 - RNA, 18 nt, Artificial Sequence
  Synthetic
gcacuccagccugggcga

SEQ ID NO: 22591 - RNA, 19 nt, Artificial Sequence
  Synthetic
ugcacuccagccugggcga

SEQ ID NO: 22592 - RNA, 20 nt, Artificial Sequence
  Synthetic
cugcacuccagccugggcga

SEQ ID NO: 22593 - RNA, 21 nt, Artificial Sequence
  Synthetic
acugcacuccagccugggcga

SEQ ID NO: 22594 - RNA, 22 nt, Artificial Sequence
  Synthetic
cacugcacuccagccugggcga

SEQ ID NO: 22595 - RNA, 23 nt, Artificial Sequence
  Synthetic
ccacugcacuccagccugggcga

SEQ ID NO: 22596 - RNA, 24 nt, Artificial Sequence
  Synthetic
gccacugcacuccagccugggcga

SEQ ID NO: 22597 - RNA, 18 nt, Artificial Sequence
  Synthetic
ugacuucauaauaaagga

SEQ ID NO: 22598 - RNA, 19 nt, Artificial Sequence
  Synthetic
gugacuucauaauaaagga

SEQ ID NO: 22599 - RNA, 20 nt, Artificial Sequence
  Synthetic
agugacuucauaauaaagga

SEQ ID NO: 22600 - RNA, 21 nt, Artificial Sequence
  Synthetic
cagugacuucauaauaaagga

SEQ ID NO: 22601 - RNA, 22 nt, Artificial Sequence
  Synthetic
acagugacuucauaauaaagga

SEQ ID NO: 22602 - RNA, 23 nt, Artificial Sequence
  Synthetic
uacagugacuucauaauaaagga

SEQ ID NO: 22603 - RNA, 24 nt, Artificial Sequence
  Synthetic
auacagugacuucauaauaaagga

SEQ ID NO: 22604 - RNA, 18 nt, Artificial Sequence
  Synthetic
augcagacaacagaagga

SEQ ID NO: 22605 - RNA, 19 nt, Artificial Sequence
  Synthetic
gaugcagacaacagaagga

SEQ ID NO: 22606 - RNA, 20 nt, Artificial Sequence
  Synthetic
ugaugcagacaacagaagga

SEQ ID NO: 22607 - RNA, 21 nt, Artificial Sequence
  Synthetic
gugaugcagacaacagaagga

SEQ ID NO: 22608 - RNA, 22 nt, Artificial Sequence
  Synthetic
ugugaugcagacaacagaagga

SEQ ID NO: 22609 - RNA, 23 nt, Artificial Sequence
  Synthetic
cugugaugcagacaacagaagga

SEQ ID NO: 22610 - RNA, 24 nt, Artificial Sequence
  Synthetic
gcugugaugcagacaacagaagga

SEQ ID NO: 22611 - RNA, 18 nt, Artificial Sequence
  Synthetic
uaaaacugaguagaagga

SEQ ID NO: 22612 - RNA, 19 nt, Artificial Sequence
  Synthetic
cuaaaacugaguagaagga

SEQ ID NO: 22613 - RNA, 20 nt, Artificial Sequence
  Synthetic
acuaaaacugaguagaagga

SEQ ID NO: 22614 - RNA, 21 nt, Artificial Sequence
  Synthetic
gacuaaaacugaguagaagga

SEQ ID NO: 22615 - RNA, 22 nt, Artificial Sequence
  Synthetic
ugacuaaaacugaguagaagga

SEQ ID NO: 22616 - RNA, 23 nt, Artificial Sequence
  Synthetic
cugacuaaaacugaguagaagga

SEQ ID NO: 22617 - RNA, 24 nt, Artificial Sequence
  Synthetic
acugacuaaaacugaguagaagga

SEQ ID NO: 22618 - RNA, 18 nt, Artificial Sequence
  Synthetic
uguaggaaaacaacugga

SEQ ID NO: 22619 - RNA, 19 nt, Artificial Sequence
  Synthetic
auguaggaaaacaacugga

SEQ ID NO: 22620 - RNA, 20 nt, Artificial Sequence
  Synthetic
uauguaggaaaacaacugga

SEQ ID NO: 22621 - RNA, 21 nt, Artificial Sequence
  Synthetic
guauguaggaaaacaacugga

SEQ ID NO: 22622 - RNA, 22 nt, Artificial Sequence
  Synthetic
cguauguaggaaaacaacugga

SEQ ID NO: 22623 - RNA, 23 nt, Artificial Sequence
  Synthetic
ucguauguaggaaaacaacugga

SEQ ID NO: 22624 - RNA, 24 nt, Artificial Sequence
  Synthetic
uucguauguaggaaaacaacugga

SEQ ID NO: 22625 - RNA, 18 nt, Artificial Sequence
  Synthetic
aauaugcaauuuacugga

SEQ ID NO: 22626 - RNA, 19 nt, Artificial Sequence
  Synthetic
caauaugcaauuuacugga

SEQ ID NO: 22627 - RNA, 20 nt, Artificial Sequence
  Synthetic
gcaauaugcaauuuacugga

SEQ ID NO: 22628 - RNA, 21 nt, Artificial Sequence
  Synthetic
ugcaauaugcaauuuacugga

SEQ ID NO: 22629 - RNA, 22 nt, Artificial Sequence
  Synthetic
cugcaauaugcaauuuacugga

SEQ ID NO: 22630 - RNA, 23 nt, Artificial Sequence
  Synthetic
acugcaauaugcaauuuacugga

SEQ ID NO: 22631 - RNA, 24 nt, Artificial Sequence
  Synthetic
uacugcaauaugcaauuuacugga

SEQ ID NO: 22632 - RNA, 18 nt, Artificial Sequence
  Synthetic
uuucaucuuacuugauga

SEQ ID NO: 22633 - RNA, 19 nt, Artificial Sequence
  Synthetic
guuucaucuuacuugauga

SEQ ID NO: 22634 - RNA, 20 nt, Artificial Sequence
  Synthetic
aguuucaucuuacuugauga

SEQ ID NO: 22635 - RNA, 21 nt, Artificial Sequence
  Synthetic
caguuucaucuuacuugauga

SEQ ID NO: 22636 - RNA, 22 nt, Artificial Sequence
  Synthetic
acaguuucaucuuacuugauga

SEQ ID NO: 22637 - RNA, 23 nt, Artificial Sequence
  Synthetic
aacaguuucaucuuacuugauga

SEQ ID NO: 22638 - RNA, 24 nt, Artificial Sequence
  Synthetic
uaacaguuucaucuuacuugauga

SEQ ID NO: 22639 - RNA, 18 nt, Artificial Sequence
  Synthetic
ugacaccaaauuuauuga

SEQ ID NO: 22640 - RNA, 19 nt, Artificial Sequence
  Synthetic
cugacaccaaauuuauuga

SEQ ID NO: 22641 - RNA, 20 nt, Artificial Sequence
  Synthetic
ccugacaccaaauuuauuga

SEQ ID NO: 22642 - RNA, 21 nt, Artificial Sequence
  Synthetic
gccugacaccaaauuuauuga

SEQ ID NO: 22643 - RNA, 22 nt, Artificial Sequence
  Synthetic
agccugacaccaaauuuauuga

SEQ ID NO: 22644 - RNA, 23 nt, Artificial Sequence
  Synthetic
cagccugacaccaaauuuauuga

SEQ ID NO: 22645 - RNA, 24 nt, Artificial Sequence
  Synthetic
ccagccugacaccaaauuuauuga

SEQ ID NO: 22646 - RNA, 18 nt, Artificial Sequence
  Synthetic
cuaauagccuauuguuga

SEQ ID NO: 22647 - RNA, 19 nt, Artificial Sequence
  Synthetic
acuaauagccuauuguuga

SEQ ID NO: 22648 - RNA, 20 nt, Artificial Sequence
  Synthetic
uacuaauagccuauuguuga

SEQ ID NO: 22649 - RNA, 21 nt, Artificial Sequence
  Synthetic
cuacuaauagccuauuguuga

SEQ ID NO: 22650 - RNA, 22 nt, Artificial Sequence
  Synthetic
acuacuaauagccuauuguuga

SEQ ID NO: 22651 - RNA, 23 nt, Artificial Sequence
  Synthetic
aacuacuaauagccuauuguuga

SEQ ID NO: 22652 - RNA, 24 nt, Artificial Sequence
  Synthetic
uaacuacuaauagccuauuguuga

SEQ ID NO: 22653 - RNA, 18 nt, Artificial Sequence
  Synthetic
ccuuggaauauaaaaaua

SEQ ID NO: 22654 - RNA, 19 nt, Artificial Sequence
  Synthetic
uccuuggaauauaaaaaua

SEQ ID NO: 22655 - RNA, 20 nt, Artificial Sequence
  Synthetic
guccuuggaauauaaaaaua

SEQ ID NO: 22656 - RNA, 21 nt, Artificial Sequence
  Synthetic
aguccuuggaauauaaaaaua

SEQ ID NO: 22657 - RNA, 22 nt, Artificial Sequence
  Synthetic
caguccuuggaauauaaaaaua

SEQ ID NO: 22658 - RNA, 23 nt, Artificial Sequence
  Synthetic
acaguccuuggaauauaaaaaua

SEQ ID NO: 22659 - RNA, 24 nt, Artificial Sequence
  Synthetic
gacaguccuuggaauauaaaaaua

SEQ ID NO: 22660 - RNA, 18 nt, Artificial Sequence
  Synthetic
cuuuguguuaacaaaaua

SEQ ID NO: 22661 - RNA, 19 nt, Artificial Sequence
  Synthetic
ucuuuguguuaacaaaaua

SEQ ID NO: 22662 - RNA, 20 nt, Artificial Sequence
  Synthetic
uucuuuguguuaacaaaaua

SEQ ID NO: 22663 - RNA, 21 nt, Artificial Sequence
  Synthetic
guucuuuguguuaacaaaaua

SEQ ID NO: 22664 - RNA, 22 nt, Artificial Sequence
  Synthetic
uguucuuuguguuaacaaaaua

SEQ ID NO: 22665 - RNA, 23 nt, Artificial Sequence
  Synthetic
uuguucuuuguguuaacaaaaua

SEQ ID NO: 22666 - RNA, 24 nt, Artificial Sequence
  Synthetic
guuguucuuuguguuaacaaaaua

SEQ ID NO: 22667 - RNA, 18 nt, Artificial Sequence
  Synthetic
ggaagaaaaguaucaaua

SEQ ID NO: 22668 - RNA, 19 nt, Artificial Sequence
  Synthetic
aggaagaaaaguaucaaua

SEQ ID NO: 22669 - RNA, 20 nt, Artificial Sequence
  Synthetic
caggaagaaaaguaucaaua

SEQ ID NO: 22670 - RNA, 21 nt, Artificial Sequence
  Synthetic
ucaggaagaaaaguaucaaua

SEQ ID NO: 22671 - RNA, 22 nt, Artificial Sequence
  Synthetic
aucaggaagaaaaguaucaaua

SEQ ID NO: 22672 - RNA, 23 nt, Artificial Sequence
  Synthetic
aaucaggaagaaaaguaucaaua

SEQ ID NO: 22673 - RNA, 24 nt, Artificial Sequence
  Synthetic
uaaucaggaagaaaaguaucaaua

SEQ ID NO: 22674 - RNA, 18 nt, Artificial Sequence
  Synthetic
uccucugugcuuugaaua

SEQ ID NO: 22675 - RNA, 19 nt, Artificial Sequence
  Synthetic
guccucugugcuuugaaua

SEQ ID NO: 22676 - RNA, 21 nt, Artificial Sequence
  Synthetic
aaguccucugugcuuugaaua

SEQ ID NO: 22677 - RNA, 22 nt, Artificial Sequence
  Synthetic
caaguccucugugcuuugaaua

SEQ ID NO: 22678 - RNA, 23 nt, Artificial Sequence
  Synthetic
gcaaguccucugugcuuugaaua

SEQ ID NO: 22679 - RNA, 24 nt, Artificial Sequence
  Synthetic
ugcaaguccucugugcuuugaaua

SEQ ID NO: 22680 - RNA, 18 nt, Artificial Sequence
  Synthetic
uacagugacuucauaaua

SEQ ID NO: 22681 - RNA, 19 nt, Artificial Sequence
  Synthetic
auacagugacuucauaaua

SEQ ID NO: 22682 - RNA, 20 nt, Artificial Sequence
  Synthetic
aauacagugacuucauaaua

SEQ ID NO: 22683 - RNA, 21 nt, Artificial Sequence
  Synthetic
caauacagugacuucauaaua

SEQ ID NO: 22684 - RNA, 22 nt, Artificial Sequence
  Synthetic
acaauacagugacuucauaaua

SEQ ID NO: 22685 - RNA, 23 nt, Artificial Sequence
  Synthetic
gacaauacagugacuucauaaua

SEQ ID NO: 22686 - RNA, 24 nt, Artificial Sequence
  Synthetic
agacaauacagugacuucauaaua

SEQ ID NO: 22687 - RNA, 18 nt, Artificial Sequence
  Synthetic
ccuagaugauuauuaaua

SEQ ID NO: 22688 - RNA, 19 nt, Artificial Sequence
  Synthetic
gccuagaugauuauuaaua

SEQ ID NO: 22689 - RNA, 21 nt, Artificial Sequence
  Synthetic
cagccuagaugauuauuaaua

SEQ ID NO: 22690 - RNA, 22 nt, Artificial Sequence
  Synthetic
gcagccuagaugauuauuaaua

SEQ ID NO: 22691 - RNA, 23 nt, Artificial Sequence
  Synthetic
ugcagccuagaugauuauuaaua

SEQ ID NO: 22692 - RNA, 24 nt, Artificial Sequence
  Synthetic
uugcagccuagaugauuauuaaua

SEQ ID NO: 22693 - RNA, 18 nt, Artificial Sequence
  Synthetic
uaguauaauuuuuuaaua

SEQ ID NO: 22694 - RNA, 19 nt, Artificial Sequence
  Synthetic
auaguauaauuuuuuaaua

SEQ ID NO: 22695 - RNA, 20 nt, Artificial Sequence
  Synthetic
uauaguauaauuuuuuaaua

SEQ ID NO: 22696 - RNA, 21 nt, Artificial Sequence
  Synthetic
cuauaguauaauuuuuuaaua

SEQ ID NO: 22697 - RNA, 22 nt, Artificial Sequence
  Synthetic
ccuauaguauaauuuuuuaaua

SEQ ID NO: 22698 - RNA, 23 nt, Artificial Sequence
  Synthetic
uccuauaguauaauuuuuuaaua

SEQ ID NO: 22699 - RNA, 24 nt, Artificial Sequence
  Synthetic
cuccuauaguauaauuuuuuaaua

SEQ ID NO: 22700 - RNA, 18 nt, Artificial Sequence
  Synthetic
ugaaacaaauaaaacaua

SEQ ID NO: 22701 - RNA, 19 nt, Artificial Sequence
  Synthetic
augaaacaaauaaaacaua

SEQ ID NO: 22702 - RNA, 20 nt, Artificial Sequence
  Synthetic
aaugaaacaaauaaaacaua

SEQ ID NO: 22703 - RNA, 21 nt, Artificial Sequence
  Synthetic
aaaugaaacaaauaaaacaua

SEQ ID NO: 22704 - RNA, 22 nt, Artificial Sequence
  Synthetic
gaaaugaaacaaauaaaacaua

SEQ ID NO: 22705 - RNA, 23 nt, Artificial Sequence
  Synthetic
agaaaugaaacaaauaaaacaua

SEQ ID NO: 22706 - RNA, 24 nt, Artificial Sequence
  Synthetic
aagaaaugaaacaaauaaaacaua

SEQ ID NO: 22707 - RNA, 18 nt, Artificial Sequence
  Synthetic
cuaaaacucaguaccaua

SEQ ID NO: 22708 - RNA, 19 nt, Artificial Sequence
  Synthetic
gcuaaaacucaguaccaua

SEQ ID NO: 22709 - RNA, 20 nt, Artificial Sequence
  Synthetic
agcuaaaacucaguaccaua

SEQ ID NO: 22710 - RNA, 21 nt, Artificial Sequence
  Synthetic
aagcuaaaacucaguaccaua

SEQ ID NO: 22711 - RNA, 22 nt, Artificial Sequence
  Synthetic
uaagcuaaaacucaguaccaua

SEQ ID NO: 22712 - RNA, 23 nt, Artificial Sequence
  Synthetic
auaagcuaaaacucaguaccaua

SEQ ID NO: 22713 - RNA, 24 nt, Artificial Sequence
  Synthetic
aauaagcuaaaacucaguaccaua

SEQ ID NO: 22714 - RNA, 18 nt, Artificial Sequence
  Synthetic
aaaauauauauaugcaua

SEQ ID NO: 22715 - RNA, 19 nt, Artificial Sequence
  Synthetic
aaaaauauauauaugcaua

SEQ ID NO: 22716 - RNA, 20 nt, Artificial Sequence
  Synthetic
uaaaaauauauauaugcaua

SEQ ID NO: 22717 - RNA, 21 nt, Artificial Sequence
  Synthetic
uuaaaaauauauauaugcaua

SEQ ID NO: 22718 - RNA, 22 nt, Artificial Sequence
  Synthetic
guuaaaaauauauauaugcaua

SEQ ID NO: 22719 - RNA, 23 nt, Artificial Sequence
  Synthetic
gguuaaaaauauauauaugcaua

SEQ ID NO: 22720 - RNA, 24 nt, Artificial Sequence
  Synthetic
agguuaaaaauauauauaugcaua

SEQ ID NO: 22721 - RNA, 18 nt, Artificial Sequence
  Synthetic
acauagagaaaacucaua

SEQ ID NO: 22722 - RNA, 19 nt, Artificial Sequence
  Synthetic
aacauagagaaaacucaua

SEQ ID NO: 22723 - RNA, 21 nt, Artificial Sequence
  Synthetic
aaaacauagagaaaacucaua

SEQ ID NO: 22724 - RNA, 22 nt, Artificial Sequence
  Synthetic
uaaaacauagagaaaacucaua

SEQ ID NO: 22725 - RNA, 23 nt, Artificial Sequence
  Synthetic
auaaaacauagagaaaacucaua

SEQ ID NO: 22726 - RNA, 24 nt, Artificial Sequence
  Synthetic
aauaaaacauagagaaaacucaua

SEQ ID NO: 22727 - RNA, 18 nt, Artificial Sequence
  Synthetic
ggaaaguuguccaagaua

SEQ ID NO: 22728 - RNA, 19 nt, Artificial Sequence
  Synthetic
uggaaaguuguccaagaua

SEQ ID NO: 22729 - RNA, 20 nt, Artificial Sequence
  Synthetic
auggaaaguuguccaagaua

SEQ ID NO: 22730 - RNA, 21 nt, Artificial Sequence
  Synthetic
uauggaaaguuguccaagaua

SEQ ID NO: 22731 - RNA, 22 nt, Artificial Sequence
  Synthetic
auauggaaaguuguccaagaua

SEQ ID NO: 22732 - RNA, 23 nt, Artificial Sequence
  Synthetic
aauauggaaaguuguccaagaua

SEQ ID NO: 22733 - RNA, 24 nt, Artificial Sequence
  Synthetic
gaauauggaaaguuguccaagaua

SEQ ID NO: 22734 - RNA, 18 nt, Artificial Sequence
  Synthetic
uguucuuagggugggaua

SEQ ID NO: 22735 - RNA, 19 nt, Artificial Sequence
  Synthetic
uuguucuuagggugggaua

SEQ ID NO: 22736 - RNA, 21 nt, Artificial Sequence
  Synthetic
aguuguucuuagggugggaua

SEQ ID NO: 22737 - RNA, 22 nt, Artificial Sequence
  Synthetic
aaguuguucuuagggugggaua

SEQ ID NO: 22738 - RNA, 23 nt, Artificial Sequence
  Synthetic
uaaguuguucuuagggugggaua

SEQ ID NO: 22739 - RNA, 24 nt, Artificial Sequence
  Synthetic
uuaaguuguucuuagggugggaua

SEQ ID NO: 22740 - RNA, 18 nt, Artificial Sequence
  Synthetic
auauugauuauauauaua

SEQ ID NO: 22741 - RNA, 19 nt, Artificial Sequence
  Synthetic
uauauugauuauauauaua

SEQ ID NO: 22742 - RNA, 20 nt, Artificial Sequence
  Synthetic
guauauugauuauauauaua

SEQ ID NO: 22743 - RNA, 21 nt, Artificial Sequence
  Synthetic
uguauauugauuauauauaua

SEQ ID NO: 22744 - RNA, 22 nt, Artificial Sequence
  Synthetic
auguauauugauuauauauaua

SEQ ID NO: 22745 - RNA, 23 nt, Artificial Sequence
  Synthetic
aauguauauugauuauauauaua

SEQ ID NO: 22746 - RNA, 24 nt, Artificial Sequence
  Synthetic
aaauguauauugauuauauauaua

SEQ ID NO: 22747 - RNA, 18 nt, Artificial Sequence
  Synthetic
guauauugauuauauaua

SEQ ID NO: 22748 - RNA, 19 nt, Artificial Sequence
  Synthetic
uguauauugauuauauaua

SEQ ID NO: 22749 - RNA, 20 nt, Artificial Sequence
  Synthetic
auguauauugauuauauaua

SEQ ID NO: 22750 - RNA, 21 nt, Artificial Sequence
  Synthetic
aauguauauugauuauauaua

SEQ ID NO: 22751 - RNA, 22 nt, Artificial Sequence
  Synthetic
aaauguauauugauuauauaua

SEQ ID NO: 22752 - RNA, 23 nt, Artificial Sequence
  Synthetic
aaaauguauauugauuauauaua

SEQ ID NO: 22753 - RNA, 24 nt, Artificial Sequence
  Synthetic
aaaaauguauauugauuauauaua

SEQ ID NO: 22754 - RNA, 18 nt, Artificial Sequence
  Synthetic
cuaggaucacuuuauaua

SEQ ID NO: 22755 - RNA, 19 nt, Artificial Sequence
  Synthetic
ucuaggaucacuuuauaua

SEQ ID NO: 22756 - RNA, 20 nt, Artificial Sequence
  Synthetic
uucuaggaucacuuuauaua

SEQ ID NO: 22757 - RNA, 21 nt, Artificial Sequence
  Synthetic
auucuaggaucacuuuauaua

SEQ ID NO: 22758 - RNA, 22 nt, Artificial Sequence
  Synthetic
gauucuaggaucacuuuauaua

SEQ ID NO: 22759 - RNA, 23 nt, Artificial Sequence
  Synthetic
ugauucuaggaucacuuuauaua

SEQ ID NO: 22760 - RNA, 24 nt, Artificial Sequence
  Synthetic
augauucuaggaucacuuuauaua

SEQ ID NO: 22761 - RNA, 18 nt, Artificial Sequence
  Synthetic
ccugaaagcaguguuaua

SEQ ID NO: 22762 - RNA, 19 nt, Artificial Sequence
  Synthetic
uccugaaagcaguguuaua

SEQ ID NO: 22763 - RNA, 20 nt, Artificial Sequence
  Synthetic
cuccugaaagcaguguuaua

SEQ ID NO: 22764 - RNA, 21 nt, Artificial Sequence
  Synthetic
gcuccugaaagcaguguuaua

SEQ ID NO: 22765 - RNA, 22 nt, Artificial Sequence
  Synthetic
ggcuccugaaagcaguguuaua

SEQ ID NO: 22766 - RNA, 23 nt, Artificial Sequence
  Synthetic
uggcuccugaaagcaguguuaua

SEQ ID NO: 22767 - RNA, 24 nt, Artificial Sequence
  Synthetic
uuggcuccugaaagcaguguuaua

SEQ ID NO: 22768 - RNA, 18 nt, Artificial Sequence
  Synthetic
uucuaggaucacuuuaua

SEQ ID NO: 22769 - RNA, 19 nt, Artificial Sequence
  Synthetic
auucuaggaucacuuuaua

SEQ ID NO: 22770 - RNA, 20 nt, Artificial Sequence
  Synthetic
gauucuaggaucacuuuaua

SEQ ID NO: 22771 - RNA, 21 nt, Artificial Sequence
  Synthetic
ugauucuaggaucacuuuaua

SEQ ID NO: 22772 - RNA, 22 nt, Artificial Sequence
  Synthetic
augauucuaggaucacuuuaua

SEQ ID NO: 22773 - RNA, 23 nt, Artificial Sequence
  Synthetic
uaugauucuaggaucacuuuaua

SEQ ID NO: 22774 - RNA, 24 nt, Artificial Sequence
  Synthetic
uuaugauucuaggaucacuuuaua

SEQ ID NO: 22775 - RNA, 18 nt, Artificial Sequence
  Synthetic
gacagaugagagacagua

SEQ ID NO: 22776 - RNA, 19 nt, Artificial Sequence
  Synthetic
ggacagaugagagacagua

SEQ ID NO: 22777 - RNA, 20 nt, Artificial Sequence
  Synthetic
uggacagaugagagacagua

SEQ ID NO: 22778 - RNA, 21 nt, Artificial Sequence
  Synthetic
auggacagaugagagacagua

SEQ ID NO: 22779 - RNA, 22 nt, Artificial Sequence
  Synthetic
aauggacagaugagagacagua

SEQ ID NO: 22780 - RNA, 23 nt, Artificial Sequence
  Synthetic
aaauggacagaugagagacagua

SEQ ID NO: 22781 - RNA, 24 nt, Artificial Sequence
  Synthetic
aaaauggacagaugagagacagua

SEQ ID NO: 22782 - RNA, 18 nt, Artificial Sequence
  Synthetic
uuucuagaaaacaaugua

SEQ ID NO: 22783 - RNA, 19 nt, Artificial Sequence
  Synthetic
uuuucuagaaaacaaugua

SEQ ID NO: 22784 - RNA, 20 nt, Artificial Sequence
  Synthetic
auuuucuagaaaacaaugua

SEQ ID NO: 22785 - RNA, 21 nt, Artificial Sequence
  Synthetic
gauuuucuagaaaacaaugua

SEQ ID NO: 22786 - RNA, 22 nt, Artificial Sequence
  Synthetic
agauuuucuagaaaacaaugua

SEQ ID NO: 22787 - RNA, 23 nt, Artificial Sequence
  Synthetic
cagauuuucuagaaaacaaugua

SEQ ID NO: 22788 - RNA, 24 nt, Artificial Sequence
  Synthetic
acagauuuucuagaaaacaaugua

SEQ ID NO: 22789 - RNA, 18 nt, Artificial Sequence
  Synthetic
guauaaguguggagugua

SEQ ID NO: 22790 - RNA, 19 nt, Artificial Sequence
  Synthetic
gguauaaguguggagugua

SEQ ID NO: 22791 - RNA, 20 nt, Artificial Sequence
  Synthetic
ggguauaaguguggagugua

SEQ ID NO: 22792 - RNA, 21 nt, Artificial Sequence
  Synthetic
gggguauaaguguggagugua

SEQ ID NO: 22793 - RNA, 22 nt, Artificial Sequence
  Synthetic
ugggguauaaguguggagugua

SEQ ID NO: 22794 - RNA, 23 nt, Artificial Sequence
  Synthetic
augggguauaaguguggagugua

SEQ ID NO: 22795 - RNA, 24 nt, Artificial Sequence
  Synthetic
aaugggguauaaguguggagugua

SEQ ID NO: 22796 - RNA, 18 nt, Artificial Sequence
  Synthetic
uucuugaagcaaaaauua

SEQ ID NO: 22797 - RNA, 19 nt, Artificial Sequence
  Synthetic
auucuugaagcaaaaauua

SEQ ID NO: 22798 - RNA, 20 nt, Artificial Sequence
  Synthetic
uauucuugaagcaaaaauua

SEQ ID NO: 22799 - RNA, 21 nt, Artificial Sequence
  Synthetic
auauucuugaagcaaaaauua

SEQ ID NO: 22800 - RNA, 22 nt, Artificial Sequence
  Synthetic
aauauucuugaagcaaaaauua

SEQ ID NO: 22801 - RNA, 23 nt, Artificial Sequence
  Synthetic
caauauucuugaagcaaaaauua

SEQ ID NO: 22802 - RNA, 24 nt, Artificial Sequence
  Synthetic
gcaauauucuugaagcaaaaauua

SEQ ID NO: 22803 - RNA, 18 nt, Artificial Sequence
  Synthetic
cugaauaacacgccauua

SEQ ID NO: 22804 - RNA, 19 nt, Artificial Sequence
  Synthetic
gcugaauaacacgccauua

SEQ ID NO: 22805 - RNA, 20 nt, Artificial Sequence
  Synthetic
ggcugaauaacacgccauua

SEQ ID NO: 22806 - RNA, 21 nt, Artificial Sequence
  Synthetic
uggcugaauaacacgccauua

SEQ ID NO: 22807 - RNA, 22 nt, Artificial Sequence
  Synthetic
uuggcugaauaacacgccauua

SEQ ID NO: 22808 - RNA, 23 nt, Artificial Sequence
  Synthetic
auuggcugaauaacacgccauua

SEQ ID NO: 22809 - RNA, 24 nt, Artificial Sequence
  Synthetic
uauuggcugaauaacacgccauua

SEQ ID NO: 22810 - RNA, 18 nt, Artificial Sequence
  Synthetic
uuaucagagcucauauua

SEQ ID NO: 22811 - RNA, 19 nt, Artificial Sequence
  Synthetic
uuuaucagagcucauauua

SEQ ID NO: 22812 - RNA, 20 nt, Artificial Sequence
  Synthetic
uuuuaucagagcucauauua

SEQ ID NO: 22813 - RNA, 21 nt, Artificial Sequence
  Synthetic
auuuuaucagagcucauauua

SEQ ID NO: 22814 - RNA, 22 nt, Artificial Sequence
  Synthetic
gauuuuaucagagcucauauua

SEQ ID NO: 22815 - RNA, 23 nt, Artificial Sequence
  Synthetic
ugauuuuaucagagcucauauua

SEQ ID NO: 22816 - RNA, 24 nt, Artificial Sequence
  Synthetic
cugauuuuaucagagcucauauua

SEQ ID NO: 22817 - RNA, 18 nt, Artificial Sequence
  Synthetic
caaaugcuugaccacuua

SEQ ID NO: 22818 - RNA, 19 nt, Artificial Sequence
  Synthetic
acaaaugcuugaccacuua

SEQ ID NO: 22819 - RNA, 20 nt, Artificial Sequence
  Synthetic
cacaaaugcuugaccacuua

SEQ ID NO: 22820 - RNA, 21 nt, Artificial Sequence
  Synthetic
acacaaaugcuugaccacuua

SEQ ID NO: 22821 - RNA, 22 nt, Artificial Sequence
  Synthetic
uacacaaaugcuugaccacuua

SEQ ID NO: 22822 - RNA, 23 nt, Artificial Sequence
  Synthetic
guacacaaaugcuugaccacuua

SEQ ID NO: 22823 - RNA, 24 nt, Artificial Sequence
  Synthetic
aguacacaaaugcuugaccacuua

SEQ ID NO: 22824 - RNA, 18 nt, Artificial Sequence
  Synthetic
auuaauaacaaaaucuua

SEQ ID NO: 22825 - RNA, 19 nt, Artificial Sequence
  Synthetic
uauuaauaacaaaaucuua

SEQ ID NO: 22826 - RNA, 20 nt, Artificial Sequence
  Synthetic
auauuaauaacaaaaucuua

SEQ ID NO: 22827 - RNA, 21 nt, Artificial Sequence
  Synthetic
aauauuaauaacaaaaucuua

SEQ ID NO: 22828 - RNA, 22 nt, Artificial Sequence
  Synthetic
uaauauuaauaacaaaaucuua

SEQ ID NO: 22829 - RNA, 23 nt, Artificial Sequence
  Synthetic
guaauauuaauaacaaaaucuua

SEQ ID NO: 22830 - RNA, 24 nt, Artificial Sequence
  Synthetic
aguaauauuaauaacaaaaucuua

SEQ ID NO: 22831 - RNA, 18 nt, Artificial Sequence
  Synthetic
acauauuuggguaaguua

SEQ ID NO: 22832 - RNA, 19 nt, Artificial Sequence
  Synthetic
aacauauuuggguaaguua

SEQ ID NO: 22833 - RNA, 20 nt, Artificial Sequence
  Synthetic
aaacauauuuggguaaguua

SEQ ID NO: 22834 - RNA, 21 nt, Artificial Sequence
  Synthetic
caaacauauuuggguaaguua

SEQ ID NO: 22835 - RNA, 22 nt, Artificial Sequence
  Synthetic
gcaaacauauuuggguaaguua

SEQ ID NO: 22836 - RNA, 23 nt, Artificial Sequence
  Synthetic
ugcaaacauauuuggguaaguua

SEQ ID NO: 22837 - RNA, 24 nt, Artificial Sequence
  Synthetic
cugcaaacauauuuggguaaguua

SEQ ID NO: 22838 - RNA, 18 nt, Artificial Sequence
  Synthetic
acugcaauaugcaauuua

SEQ ID NO: 22839 - RNA, 19 nt, Artificial Sequence
  Synthetic
uacugcaauaugcaauuua

SEQ ID NO: 22840 - RNA, 20 nt, Artificial Sequence
  Synthetic
uuacugcaauaugcaauuua

SEQ ID NO: 22841 - RNA, 21 nt, Artificial Sequence
  Synthetic
uuuacugcaauaugcaauuua

SEQ ID NO: 22842 - RNA, 22 nt, Artificial Sequence
  Synthetic
uuuuacugcaauaugcaauuua

SEQ ID NO: 22843 - RNA, 23 nt, Artificial Sequence
  Synthetic
uuuuuacugcaauaugcaauuua

SEQ ID NO: 22844 - RNA, 24 nt, Artificial Sequence
  Synthetic
cuuuuuacugcaauaugcaauuua

SEQ ID NO: 22845 - RNA, 18 nt, Artificial Sequence
  Synthetic
ccuauuauucaacauuua

SEQ ID NO: 22846 - RNA, 19 nt, Artificial Sequence
  Synthetic
cccuauuauucaacauuua

SEQ ID NO: 22847 - RNA, 21 nt, Artificial Sequence
  Synthetic
accccuauuauucaacauuua

SEQ ID NO: 22848 - RNA, 22 nt, Artificial Sequence
  Synthetic
aaccccuauuauucaacauuua

SEQ ID NO: 22849 - RNA, 23 nt, Artificial Sequence
  Synthetic
aaaccccuauuauucaacauuua

SEQ ID NO: 22850 - RNA, 24 nt, Artificial Sequence
  Synthetic
caaaccccuauuauucaacauuua

SEQ ID NO: 22851 - RNA, 18 nt, Artificial Sequence
  Synthetic
uaaaaagcaagcaaaaac

SEQ ID NO: 22852 - RNA, 19 nt, Artificial Sequence
  Synthetic
auaaaaagcaagcaaaaac

SEQ ID NO: 22853 - RNA, 20 nt, Artificial Sequence
  Synthetic
uauaaaaagcaagcaaaaac

SEQ ID NO: 22854 - RNA, 21 nt, Artificial Sequence
  Synthetic
guauaaaaagcaagcaaaaac

SEQ ID NO: 22855 - RNA, 22 nt, Artificial Sequence
  Synthetic
uguauaaaaagcaagcaaaaac

SEQ ID NO: 22856 - RNA, 23 nt, Artificial Sequence
  Synthetic
cuguauaaaaagcaagcaaaaac

SEQ ID NO: 22857 - RNA, 24 nt, Artificial Sequence
  Synthetic
ucuguauaaaaagcaagcaaaaac

SEQ ID NO: 22858 - RNA, 18 nt, Artificial Sequence
  Synthetic
aacaucuaacucaaaaac

SEQ ID NO: 22859 - RNA, 19 nt, Artificial Sequence
  Synthetic
aaacaucuaacucaaaaac

SEQ ID NO: 22860 - RNA, 20 nt, Artificial Sequence
  Synthetic
caaacaucuaacucaaaaac

SEQ ID NO: 22861 - RNA, 21 nt, Artificial Sequence
  Synthetic
ucaaacaucuaacucaaaaac

SEQ ID NO: 22862 - RNA, 22 nt, Artificial Sequence
  Synthetic
gucaaacaucuaacucaaaaac

SEQ ID NO: 22863 - RNA, 23 nt, Artificial Sequence
  Synthetic
cgucaaacaucuaacucaaaaac

SEQ ID NO: 22864 - RNA, 24 nt, Artificial Sequence
  Synthetic
gcgucaaacaucuaacucaaaaac

SEQ ID NO: 22865 - RNA, 18 nt, Artificial Sequence
  Synthetic
cguauguaggaaaacaac

SEQ ID NO: 22866 - RNA, 19 nt, Artificial Sequence
  Synthetic
ucguauguaggaaaacaac

SEQ ID NO: 22867 - RNA, 21 nt, Artificial Sequence
  Synthetic
uuucguauguaggaaaacaac

SEQ ID NO: 22868 - RNA, 22 nt, Artificial Sequence
  Synthetic
guuucguauguaggaaaacaac

SEQ ID NO: 22869 - RNA, 23 nt, Artificial Sequence
  Synthetic
uguuucguauguaggaaaacaac

SEQ ID NO: 22870 - RNA, 24 nt, Artificial Sequence
  Synthetic
cuguuucguauguaggaaaacaac

SEQ ID NO: 22871 - RNA, 18 nt, Artificial Sequence
  Synthetic
gcuuaccguaauagcaac

SEQ ID NO: 22872 - RNA, 19 nt, Artificial Sequence
  Synthetic
agcuuaccguaauagcaac

SEQ ID NO: 22873 - RNA, 21 nt, Artificial Sequence
  Synthetic
ugagcuuaccguaauagcaac

SEQ ID NO: 22874 - RNA, 22 nt, Artificial Sequence
  Synthetic
uugagcuuaccguaauagcaac

SEQ ID NO: 22875 - RNA, 23 nt, Artificial Sequence
  Synthetic
cuugagcuuaccguaauagcaac

SEQ ID NO: 22876 - RNA, 24 nt, Artificial Sequence
  Synthetic
gcuugagcuuaccguaauagcaac

SEQ ID NO: 22877 - RNA, 18 nt, Artificial Sequence
  Synthetic
cauugacccuuuaucaac

SEQ ID NO: 22878 - RNA, 19 nt, Artificial Sequence
  Synthetic
ccauugacccuuuaucaac

SEQ ID NO: 22879 - RNA, 20 nt, Artificial Sequence
  Synthetic
accauugacccuuuaucaac

SEQ ID NO: 22880 - RNA, 21 nt, Artificial Sequence
  Synthetic
uaccauugacccuuuaucaac

SEQ ID NO: 22881 - RNA, 22 nt, Artificial Sequence
  Synthetic
auaccauugacccuuuaucaac

SEQ ID NO: 22882 - RNA, 23 nt, Artificial Sequence
  Synthetic
uauaccauugacccuuuaucaac

SEQ ID NO: 22883 - RNA, 24 nt, Artificial Sequence
  Synthetic
auauaccauugacccuuuaucaac

SEQ ID NO: 22884 - RNA, 18 nt, Artificial Sequence
  Synthetic
ugacaaucaaaugggaac

SEQ ID NO: 22885 - RNA, 19 nt, Artificial Sequence
  Synthetic
augacaaucaaaugggaac

SEQ ID NO: 22886 - RNA, 20 nt, Artificial Sequence
  Synthetic
aaugacaaucaaaugggaac

SEQ ID NO: 22887 - RNA, 21 nt, Artificial Sequence
  Synthetic
aaaugacaaucaaaugggaac

SEQ ID NO: 22888 - RNA, 22 nt, Artificial Sequence
  Synthetic
aaaaugacaaucaaaugggaac

SEQ ID NO: 22889 - RNA, 23 nt, Artificial Sequence
  Synthetic
uaaaaugacaaucaaaugggaac

SEQ ID NO: 22890 - RNA, 24 nt, Artificial Sequence
  Synthetic
cuaaaaugacaaucaaaugggaac

SEQ ID NO: 22891 - RNA, 18 nt, Artificial Sequence
  Synthetic
caggagaauggcgugaac

SEQ ID NO: 22892 - RNA, 19 nt, Artificial Sequence
  Synthetic
gcaggagaauggcgugaac

SEQ ID NO: 22893 - RNA, 20 nt, Artificial Sequence
  Synthetic
ggcaggagaauggcgugaac

SEQ ID NO: 22894 - RNA, 21 nt, Artificial Sequence
  Synthetic
aggcaggagaauggcgugaac

SEQ ID NO: 22895 - RNA, 22 nt, Artificial Sequence
  Synthetic
gaggcaggagaauggcgugaac

SEQ ID NO: 22896 - RNA, 23 nt, Artificial Sequence
  Synthetic
ugaggcaggagaauggcgugaac

SEQ ID NO: 22897 - RNA, 24 nt, Artificial Sequence
  Synthetic
cugaggcaggagaauggcgugaac

SEQ ID NO: 22898 - RNA, 18 nt, Artificial Sequence
  Synthetic
gaaccuauaaggaauaac

SEQ ID NO: 22899 - RNA, 19 nt, Artificial Sequence
  Synthetic
agaaccuauaaggaauaac

SEQ ID NO: 22900 - RNA, 21 nt, Artificial Sequence
  Synthetic
acagaaccuauaaggaauaac

SEQ ID NO: 22901 - RNA, 22 nt, Artificial Sequence
  Synthetic
uacagaaccuauaaggaauaac

SEQ ID NO: 22902 - RNA, 23 nt, Artificial Sequence
  Synthetic
uuacagaaccuauaaggaauaac

SEQ ID NO: 22903 - RNA, 24 nt, Artificial Sequence
  Synthetic
auuacagaaccuauaaggaauaac

SEQ ID NO: 22904 - RNA, 18 nt, Artificial Sequence
  Synthetic
aaaauaugcgagaaccac

SEQ ID NO: 22905 - RNA, 19 nt, Artificial Sequence
  Synthetic
aaaaauaugcgagaaccac

SEQ ID NO: 22906 - RNA, 20 nt, Artificial Sequence
  Synthetic
gaaaaauaugcgagaaccac

SEQ ID NO: 22907 - RNA, 21 nt, Artificial Sequence
  Synthetic
ugaaaaauaugcgagaaccac

SEQ ID NO: 22908 - RNA, 22 nt, Artificial Sequence
  Synthetic
augaaaaauaugcgagaaccac

SEQ ID NO: 22909 - RNA, 23 nt, Artificial Sequence
  Synthetic
gaugaaaaauaugcgagaaccac

SEQ ID NO: 22910 - RNA, 24 nt, Artificial Sequence
  Synthetic
ugaugaaaaauaugcgagaaccac

SEQ ID NO: 22911 - RNA, 18 nt, Artificial Sequence
  Synthetic
aguauuaaguauagccac

SEQ ID NO: 22912 - RNA, 19 nt, Artificial Sequence
  Synthetic
uaguauuaaguauagccac

SEQ ID NO: 22913 - RNA, 21 nt, Artificial Sequence
  Synthetic
auuaguauuaaguauagccac

SEQ ID NO: 22914 - RNA, 22 nt, Artificial Sequence
  Synthetic
uauuaguauuaaguauagccac

SEQ ID NO: 22915 - RNA, 23 nt, Artificial Sequence
  Synthetic
uuauuaguauuaaguauagccac

SEQ ID NO: 22916 - RNA, 24 nt, Artificial Sequence
  Synthetic
guuauuaguauuaaguauagccac

SEQ ID NO: 22917 - RNA, 18 nt, Artificial Sequence
  Synthetic
uuuaauaaauaauaucac

SEQ ID NO: 22918 - RNA, 19 nt, Artificial Sequence
  Synthetic
uuuuaauaaauaauaucac

SEQ ID NO: 22919 - RNA, 20 nt, Artificial Sequence
  Synthetic
auuuuaauaaauaauaucac

SEQ ID NO: 22920 - RNA, 21 nt, Artificial Sequence
  Synthetic
aauuuuaauaaauaauaucac

SEQ ID NO: 22921 - RNA, 22 nt, Artificial Sequence
  Synthetic
aaauuuuaauaaauaauaucac

SEQ ID NO: 22922 - RNA, 23 nt, Artificial Sequence
  Synthetic
uaaauuuuaauaaauaauaucac

SEQ ID NO: 22923 - RNA, 24 nt, Artificial Sequence
  Synthetic
uuaaauuuuaauaaauaauaucac

SEQ ID NO: 22924 - RNA, 18 nt, Artificial Sequence
  Synthetic
ggagagagaacugcucac

SEQ ID NO: 22925 - RNA, 19 nt, Artificial Sequence
  Synthetic
uggagagagaacugcucac

SEQ ID NO: 22926 - RNA, 20 nt, Artificial Sequence
  Synthetic
cuggagagagaacugcucac

SEQ ID NO: 22927 - RNA, 21 nt, Artificial Sequence
  Synthetic
acuggagagagaacugcucac

SEQ ID NO: 22928 - RNA, 22 nt, Artificial Sequence
  Synthetic
uacuggagagagaacugcucac

SEQ ID NO: 22929 - RNA, 23 nt, Artificial Sequence
  Synthetic
uuacuggagagagaacugcucac

SEQ ID NO: 22930 - RNA, 24 nt, Artificial Sequence
  Synthetic
uuuacuggagagagaacugcucac

SEQ ID NO: 22931 - RNA, 18 nt, Artificial Sequence
  Synthetic
aagacauuuaauguagac

SEQ ID NO: 22932 - RNA, 19 nt, Artificial Sequence
  Synthetic
caagacauuuaauguagac

SEQ ID NO: 22933 - RNA, 20 nt, Artificial Sequence
  Synthetic
gcaagacauuuaauguagac

SEQ ID NO: 22934 - RNA, 21 nt, Artificial Sequence
  Synthetic
cgcaagacauuuaauguagac

SEQ ID NO: 22935 - RNA, 22 nt, Artificial Sequence
  Synthetic
gcgcaagacauuuaauguagac

SEQ ID NO: 22936 - RNA, 23 nt, Artificial Sequence
  Synthetic
agcgcaagacauuuaauguagac

SEQ ID NO: 22937 - RNA, 24 nt, Artificial Sequence
  Synthetic
aagcgcaagacauuuaauguagac

SEQ ID NO: 22938 - RNA, 18 nt, Artificial Sequence
  Synthetic
uuuagcccauucuaauac

SEQ ID NO: 22939 - RNA, 19 nt, Artificial Sequence
  Synthetic
cuuuagcccauucuaauac

SEQ ID NO: 22940 - RNA, 20 nt, Artificial Sequence
  Synthetic
ccuuuagcccauucuaauac

SEQ ID NO: 22941 - RNA, 21 nt, Artificial Sequence
  Synthetic
cccuuuagcccauucuaauac

SEQ ID NO: 22942 - RNA, 22 nt, Artificial Sequence
  Synthetic
gcccuuuagcccauucuaauac

SEQ ID NO: 22943 - RNA, 23 nt, Artificial Sequence
  Synthetic
ugcccuuuagcccauucuaauac

SEQ ID NO: 22944 - RNA, 24 nt, Artificial Sequence
  Synthetic
uugcccuuuagcccauucuaauac

SEQ ID NO: 22945 - RNA, 18 nt, Artificial Sequence
  Synthetic
uauuuguggaggacauac

SEQ ID NO: 22946 - RNA, 19 nt, Artificial Sequence
  Synthetic
auauuuguggaggacauac

SEQ ID NO: 22947 - RNA, 20 nt, Artificial Sequence
  Synthetic
aauauuuguggaggacauac

SEQ ID NO: 22948 - RNA, 21 nt, Artificial Sequence
  Synthetic
aaauauuuguggaggacauac

SEQ ID NO: 22949 - RNA, 22 nt, Artificial Sequence
  Synthetic
aaaauauuuguggaggacauac

SEQ ID NO: 22950 - RNA, 23 nt, Artificial Sequence
  Synthetic
aaaaauauuuguggaggacauac

SEQ ID NO: 22951 - RNA, 24 nt, Artificial Sequence
  Synthetic
aaaaaauauuuguggaggacauac

SEQ ID NO: 22952 - RNA, 18 nt, Artificial Sequence
  Synthetic
gccuguagucccagcuac

SEQ ID NO: 22953 - RNA, 19 nt, Artificial Sequence
  Synthetic
cgccuguagucccagcuac

SEQ ID NO: 22954 - RNA, 20 nt, Artificial Sequence
  Synthetic
gcgccuguagucccagcuac

SEQ ID NO: 22955 - RNA, 21 nt, Artificial Sequence
  Synthetic
ggcgccuguagucccagcuac

SEQ ID NO: 22956 - RNA, 22 nt, Artificial Sequence
  Synthetic
gggcgccuguagucccagcuac

SEQ ID NO: 22957 - RNA, 23 nt, Artificial Sequence
  Synthetic
cgggcgccuguagucccagcuac

SEQ ID NO: 22958 - RNA, 24 nt, Artificial Sequence
  Synthetic
gcgggcgccuguagucccagcuac

SEQ ID NO: 22959 - RNA, 19 nt, Artificial Sequence
  Synthetic
ugccuguagucccagcuac

SEQ ID NO: 22960 - RNA, 20 nt, Artificial Sequence
  Synthetic
gugccuguagucccagcuac

SEQ ID NO: 22961 - RNA, 21 nt, Artificial Sequence
  Synthetic
cgugccuguagucccagcuac

SEQ ID NO: 22962 - RNA, 22 nt, Artificial Sequence
  Synthetic
gcgugccuguagucccagcuac

SEQ ID NO: 22963 - RNA, 23 nt, Artificial Sequence
  Synthetic
ugcgugccuguagucccagcuac

SEQ ID NO: 22964 - RNA, 24 nt, Artificial Sequence
  Synthetic
gugcgugccuguagucccagcuac

SEQ ID NO: 22965 - RNA, 18 nt, Artificial Sequence
  Synthetic
acuugcuucaccugcuac

SEQ ID NO: 22966 - RNA, 19 nt, Artificial Sequence
  Synthetic
cacuugcuucaccugcuac

SEQ ID NO: 22967 - RNA, 20 nt, Artificial Sequence
  Synthetic
gcacuugcuucaccugcuac

SEQ ID NO: 22968 - RNA, 21 nt, Artificial Sequence
  Synthetic
ugcacuugcuucaccugcuac

SEQ ID NO: 22969 - RNA, 22 nt, Artificial Sequence
  Synthetic
uugcacuugcuucaccugcuac

SEQ ID NO: 22970 - RNA, 23 nt, Artificial Sequence
  Synthetic
uuugcacuugcuucaccugcuac

SEQ ID NO: 22971 - RNA, 24 nt, Artificial Sequence
  Synthetic
cuuugcacuugcuucaccugcuac

SEQ ID NO: 22972 - RNA, 18 nt, Artificial Sequence
  Synthetic
aaaucuuauagagauuac

SEQ ID NO: 22973 - RNA, 19 nt, Artificial Sequence
  Synthetic
aaaaucuuauagagauuac

SEQ ID NO: 22974 - RNA, 20 nt, Artificial Sequence
  Synthetic
caaaaucuuauagagauuac

SEQ ID NO: 22975 - RNA, 21 nt, Artificial Sequence
  Synthetic
acaaaaucuuauagagauuac

SEQ ID NO: 22976 - RNA, 22 nt, Artificial Sequence
  Synthetic
aacaaaaucuuauagagauuac

SEQ ID NO: 22977 - RNA, 23 nt, Artificial Sequence
  Synthetic
uaacaaaaucuuauagagauuac

SEQ ID NO: 22978 - RNA, 24 nt, Artificial Sequence
  Synthetic
auaacaaaaucuuauagagauuac

SEQ ID NO: 22979 - RNA, 18 nt, Artificial Sequence
  Synthetic
uuuuacaauucuuauuac

SEQ ID NO: 22980 - RNA, 19 nt, Artificial Sequence
  Synthetic
auuuuacaauucuuauuac

SEQ ID NO: 22981 - RNA, 20 nt, Artificial Sequence
  Synthetic
aauuuuacaauucuuauuac

SEQ ID NO: 22982 - RNA, 21 nt, Artificial Sequence
  Synthetic
aaauuuuacaauucuuauuac

SEQ ID NO: 22983 - RNA, 22 nt, Artificial Sequence
  Synthetic
uaaauuuuacaauucuuauuac

SEQ ID NO: 22984 - RNA, 23 nt, Artificial Sequence
  Synthetic
guaaauuuuacaauucuuauuac

SEQ ID NO: 22985 - RNA, 24 nt, Artificial Sequence
  Synthetic
aguaaauuuuacaauucuuauuac

SEQ ID NO: 22986 - RNA, 18 nt, Artificial Sequence
  Synthetic
cugcaauaugcaauuuac

SEQ ID NO: 22987 - RNA, 19 nt, Artificial Sequence
  Synthetic
acugcaauaugcaauuuac

SEQ ID NO: 22988 - RNA, 21 nt, Artificial Sequence
  Synthetic
uuacugcaauaugcaauuuac

SEQ ID NO: 22989 - RNA, 22 nt, Artificial Sequence
  Synthetic
uuuacugcaauaugcaauuuac

SEQ ID NO: 22990 - RNA, 23 nt, Artificial Sequence
  Synthetic
uuuuacugcaauaugcaauuuac

SEQ ID NO: 22991 - RNA, 24 nt, Artificial Sequence
  Synthetic
uuuuuacugcaauaugcaauuuac

SEQ ID NO: 22992 - RNA, 18 nt, Artificial Sequence
  Synthetic
uuuguacaaaauuaaacc

SEQ ID NO: 22993 - RNA, 19 nt, Artificial Sequence
  Synthetic
cuuuguacaaaauuaaacc

SEQ ID NO: 22994 - RNA, 20 nt, Artificial Sequence
  Synthetic
ccuuuguacaaaauuaaacc

SEQ ID NO: 22995 - RNA, 21 nt, Artificial Sequence
  Synthetic
uccuuuguacaaaauuaaacc

SEQ ID NO: 22996 - RNA, 22 nt, Artificial Sequence
  Synthetic
uuccuuuguacaaaauuaaacc

SEQ ID NO: 22997 - RNA, 23 nt, Artificial Sequence
  Synthetic
auuccuuuguacaaaauuaaacc

SEQ ID NO: 22998 - RNA, 24 nt, Artificial Sequence
  Synthetic
aauuccuuuguacaaaauuaaacc

SEQ ID NO: 22999 - RNA, 18 nt, Artificial Sequence
  Synthetic
aggagaauggcgugaacc

SEQ ID NO: 23000 - RNA, 19 nt, Artificial Sequence
  Synthetic
caggagaauggcgugaacc

SEQ ID NO: 23001 - RNA, 21 nt, Artificial Sequence
  Synthetic
ggcaggagaauggcgugaacc

SEQ ID NO: 23002 - RNA, 22 nt, Artificial Sequence
  Synthetic
aggcaggagaauggcgugaacc

SEQ ID NO: 23003 - RNA, 23 nt, Artificial Sequence
  Synthetic
gaggcaggagaauggcgugaacc

SEQ ID NO: 23004 - RNA, 24 nt, Artificial Sequence
  Synthetic
ugaggcaggagaauggcgugaacc

SEQ ID NO: 23005 - RNA, 18 nt, Artificial Sequence
  Synthetic
ggucuugaucuccuaacc

SEQ ID NO: 23006 - RNA, 19 nt, Artificial Sequence
  Synthetic
uggucuugaucuccuaacc

SEQ ID NO: 23007 - RNA, 20 nt, Artificial Sequence
  Synthetic
auggucuugaucuccuaacc

SEQ ID NO: 23008 - RNA, 21 nt, Artificial Sequence
  Synthetic
gauggucuugaucuccuaacc

SEQ ID NO: 23009 - RNA, 22 nt, Artificial Sequence
  Synthetic
ggauggucuugaucuccuaacc

SEQ ID NO: 23010 - RNA, 23 nt, Artificial Sequence
  Synthetic
aggauggucuugaucuccuaacc

SEQ ID NO: 23011 - RNA, 24 nt, Artificial Sequence
  Synthetic
caggauggucuugaucuccuaacc

SEQ ID NO: 23012 - RNA, 18 nt, Artificial Sequence
  Synthetic
cccugcaauaccaucacc

SEQ ID NO: 23013 - RNA, 19 nt, Artificial Sequence
  Synthetic
acccugcaauaccaucacc

SEQ ID NO: 23014 - RNA, 20 nt, Artificial Sequence
  Synthetic
cacccugcaauaccaucacc

SEQ ID NO: 23015 - RNA, 21 nt, Artificial Sequence
  Synthetic
ccacccugcaauaccaucacc

SEQ ID NO: 23016 - RNA, 22 nt, Artificial Sequence
  Synthetic
cccacccugcaauaccaucacc

SEQ ID NO: 23017 - RNA, 23 nt, Artificial Sequence
  Synthetic
ccccacccugcaauaccaucacc

SEQ ID NO: 23018 - RNA, 24 nt, Artificial Sequence
  Synthetic
gccccacccugcaauaccaucacc

SEQ ID NO: 23019 - RNA, 18 nt, Artificial Sequence
  Synthetic
guggccucuaaucucacc

SEQ ID NO: 23020 - RNA, 19 nt, Artificial Sequence
  Synthetic
aguggccucuaaucucacc

SEQ ID NO: 23021 - RNA, 20 nt, Artificial Sequence
  Synthetic
caguggccucuaaucucacc

SEQ ID NO: 23022 - RNA, 21 nt, Artificial Sequence
  Synthetic
ccaguggccucuaaucucacc

SEQ ID NO: 23023 - RNA, 22 nt, Artificial Sequence
  Synthetic
uccaguggccucuaaucucacc

SEQ ID NO: 23024 - RNA, 23 nt, Artificial Sequence
  Synthetic
cuccaguggccucuaaucucacc

SEQ ID NO: 23025 - RNA, 24 nt, Artificial Sequence
  Synthetic
ucuccaguggccucuaaucucacc

SEQ ID NO: 23026 - RNA, 18 nt, Artificial Sequence
  Synthetic
cugcuauaacaaaauacc

SEQ ID NO: 23027 - RNA, 19 nt, Artificial Sequence
  Synthetic
gcugcuauaacaaaauacc

SEQ ID NO: 23028 - RNA, 20 nt, Artificial Sequence
  Synthetic
ggcugcuauaacaaaauacc

SEQ ID NO: 23029 - RNA, 21 nt, Artificial Sequence
  Synthetic
aggcugcuauaacaaaauacc

SEQ ID NO: 23030 - RNA, 22 nt, Artificial Sequence
  Synthetic
caggcugcuauaacaaaauacc

SEQ ID NO: 23031 - RNA, 23 nt, Artificial Sequence
  Synthetic
ucaggcugcuauaacaaaauacc

SEQ ID NO: 23032 - RNA, 24 nt, Artificial Sequence
  Synthetic
uucaggcugcuauaacaaaauacc

SEQ ID NO: 23033 - RNA, 18 nt, Artificial Sequence
  Synthetic
uacagcuaaaguauuacc

SEQ ID NO: 23034 - RNA, 19 nt, Artificial Sequence
  Synthetic
auacagcuaaaguauuacc

SEQ ID NO: 23035 - RNA, 20 nt, Artificial Sequence
  Synthetic
uauacagcuaaaguauuacc

SEQ ID NO: 23036 - RNA, 21 nt, Artificial Sequence
  Synthetic
auauacagcuaaaguauuacc

SEQ ID NO: 23037 - RNA, 22 nt, Artificial Sequence
  Synthetic
aauauacagcuaaaguauuacc

SEQ ID NO: 23038 - RNA, 23 nt, Artificial Sequence
  Synthetic
uaauauacagcuaaaguauuacc

SEQ ID NO: 23039 - RNA, 24 nt, Artificial Sequence
  Synthetic
auaauauacagcuaaaguauuacc

SEQ ID NO: 23040 - RNA, 18 nt, Artificial Sequence
  Synthetic
ggagaauggcgugaaccc

SEQ ID NO: 23041 - RNA, 19 nt, Artificial Sequence
  Synthetic
aggagaauggcgugaaccc

SEQ ID NO: 23042 - RNA, 21 nt, Artificial Sequence
  Synthetic
gcaggagaauggcgugaaccc

SEQ ID NO: 23043 - RNA, 22 nt, Artificial Sequence
  Synthetic
ggcaggagaauggcgugaaccc

SEQ ID NO: 23044 - RNA, 23 nt, Artificial Sequence
  Synthetic
aggcaggagaauggcgugaaccc

SEQ ID NO: 23045 - RNA, 24 nt, Artificial Sequence
  Synthetic
gaggcaggagaauggcgugaaccc

SEQ ID NO: 23046 - RNA, 18 nt, Artificial Sequence
  Synthetic
ggagaauugcuugagccc

SEQ ID NO: 23047 - RNA, 19 nt, Artificial Sequence
  Synthetic
aggagaauugcuugagccc

SEQ ID NO: 23048 - RNA, 21 nt, Artificial Sequence
  Synthetic
gcaggagaauugcuugagccc

SEQ ID NO: 23049 - RNA, 22 nt, Artificial Sequence
  Synthetic
ggcaggagaauugcuugagccc

SEQ ID NO: 23050 - RNA, 23 nt, Artificial Sequence
  Synthetic
aggcaggagaauugcuugagccc

SEQ ID NO: 23051 - RNA, 24 nt, Artificial Sequence
  Synthetic
gaggcaggagaauugcuugagccc

SEQ ID NO: 23052 - RNA, 18 nt, Artificial Sequence
  Synthetic
aaguguuuaaauauuccc

SEQ ID NO: 23053 - RNA, 19 nt, Artificial Sequence
  Synthetic
gaaguguuuaaauauuccc

SEQ ID NO: 23054 - RNA, 20 nt, Artificial Sequence
  Synthetic
agaaguguuuaaauauuccc

SEQ ID NO: 23055 - RNA, 21 nt, Artificial Sequence
  Synthetic
cagaaguguuuaaauauuccc

SEQ ID NO: 23056 - RNA, 22 nt, Artificial Sequence
  Synthetic
ucagaaguguuuaaauauuccc

SEQ ID NO: 23057 - RNA, 23 nt, Artificial Sequence
  Synthetic
cucagaaguguuuaaauauuccc

SEQ ID NO: 23058 - RNA, 24 nt, Artificial Sequence
  Synthetic
ucucagaaguguuuaaauauuccc

SEQ ID NO: 23059 - RNA, 18 nt, Artificial Sequence
  Synthetic
ggaaaggucaauugagcc

SEQ ID NO: 23060 - RNA, 19 nt, Artificial Sequence
  Synthetic
cggaaaggucaauugagcc

SEQ ID NO: 23061 - RNA, 20 nt, Artificial Sequence
  Synthetic
gcggaaaggucaauugagcc

SEQ ID NO: 23062 - RNA, 21 nt, Artificial Sequence
  Synthetic
agcggaaaggucaauugagcc

SEQ ID NO: 23063 - RNA, 22 nt, Artificial Sequence
  Synthetic
aagcggaaaggucaauugagcc

SEQ ID NO: 23064 - RNA, 23 nt, Artificial Sequence
  Synthetic
gaagcggaaaggucaauugagcc

SEQ ID NO: 23065 - RNA, 24 nt, Artificial Sequence
  Synthetic
ugaagcggaaaggucaauugagcc

SEQ ID NO: 23066 - RNA, 18 nt, Artificial Sequence
  Synthetic
aggagaauugcuugagcc

SEQ ID NO: 23067 - RNA, 19 nt, Artificial Sequence
  Synthetic
caggagaauugcuugagcc

SEQ ID NO: 23068 - RNA, 21 nt, Artificial Sequence
  Synthetic
ggcaggagaauugcuugagcc

SEQ ID NO: 23069 - RNA, 22 nt, Artificial Sequence
  Synthetic
aggcaggagaauugcuugagcc

SEQ ID NO: 23070 - RNA, 23 nt, Artificial Sequence
  Synthetic
gaggcaggagaauugcuugagcc

SEQ ID NO: 23071 - RNA, 24 nt, Artificial Sequence
  Synthetic
ugaggcaggagaauugcuugagcc

SEQ ID NO: 23072 - RNA, 18 nt, Artificial Sequence
  Synthetic
ggcacuuguugacagucc

SEQ ID NO: 23073 - RNA, 19 nt, Artificial Sequence
  Synthetic
aggcacuuguugacagucc

SEQ ID NO: 23074 - RNA, 20 nt, Artificial Sequence
  Synthetic
uaggcacuuguugacagucc

SEQ ID NO: 23075 - RNA, 21 nt, Artificial Sequence
  Synthetic
cuaggcacuuguugacagucc

SEQ ID NO: 23076 - RNA, 22 nt, Artificial Sequence
  Synthetic
gcuaggcacuuguugacagucc

SEQ ID NO: 23077 - RNA, 23 nt, Artificial Sequence
  Synthetic
ugcuaggcacuuguugacagucc

SEQ ID NO: 23078 - RNA, 24 nt, Artificial Sequence
  Synthetic
gugcuaggcacuuguugacagucc

SEQ ID NO: 23079 - RNA, 18 nt, Artificial Sequence
  Synthetic
cuaccagcccccucuucc

SEQ ID NO: 23080 - RNA, 19 nt, Artificial Sequence
  Synthetic
acuaccagcccccucuucc

SEQ ID NO: 23081 - RNA, 20 nt, Artificial Sequence
  Synthetic
cacuaccagcccccucuucc

SEQ ID NO: 23082 - RNA, 21 nt, Artificial Sequence
  Synthetic
acacuaccagcccccucuucc

SEQ ID NO: 23083 - RNA, 22 nt, Artificial Sequence
  Synthetic
cacacuaccagcccccucuucc

SEQ ID NO: 23084 - RNA, 23 nt, Artificial Sequence
  Synthetic
ucacacuaccagcccccucuucc

SEQ ID NO: 23085 - RNA, 24 nt, Artificial Sequence
  Synthetic
uucacacuaccagcccccucuucc

SEQ ID NO: 23086 - RNA, 18 nt, Artificial Sequence
  Synthetic
caagauagugggaaaagc

SEQ ID NO: 23087 - RNA, 19 nt, Artificial Sequence
  Synthetic
ccaagauagugggaaaagc

SEQ ID NO: 23088 - RNA, 20 nt, Artificial Sequence
  Synthetic
uccaagauagugggaaaagc

SEQ ID NO: 23089 - RNA, 21 nt, Artificial Sequence
  Synthetic
guccaagauagugggaaaagc

SEQ ID NO: 23090 - RNA, 22 nt, Artificial Sequence
  Synthetic
uguccaagauagugggaaaagc

SEQ ID NO: 23091 - RNA, 23 nt, Artificial Sequence
  Synthetic
uuguccaagauagugggaaaagc

SEQ ID NO: 23092 - RNA, 24 nt, Artificial Sequence
  Synthetic
guuguccaagauagugggaaaagc

SEQ ID NO: 23093 - RNA, 18 nt, Artificial Sequence
  Synthetic
uuacucaguccagaaagc

SEQ ID NO: 23094 - RNA, 19 nt, Artificial Sequence
  Synthetic
guuacucaguccagaaagc

SEQ ID NO: 23095 - RNA, 20 nt, Artificial Sequence
  Synthetic
aguuacucaguccagaaagc

SEQ ID NO: 23096 - RNA, 21 nt, Artificial Sequence
  Synthetic
caguuacucaguccagaaagc

SEQ ID NO: 23097 - RNA, 22 nt, Artificial Sequence
  Synthetic
ccaguuacucaguccagaaagc

SEQ ID NO: 23098 - RNA, 23 nt, Artificial Sequence
  Synthetic
uccaguuacucaguccagaaagc

SEQ ID NO: 23099 - RNA, 24 nt, Artificial Sequence
  Synthetic
uuccaguuacucaguccagaaagc

SEQ ID NO: 23100 - RNA, 18 nt, Artificial Sequence
  Synthetic
ccgccacugcacuccagc

SEQ ID NO: 23101 - RNA, 19 nt, Artificial Sequence
  Synthetic
cccgccacugcacuccagc

SEQ ID NO: 23102 - RNA, 20 nt, Artificial Sequence
  Synthetic
ucccgccacugcacuccagc

SEQ ID NO: 23103 - RNA, 21 nt, Artificial Sequence
  Synthetic
aucccgccacugcacuccagc

SEQ ID NO: 23104 - RNA, 22 nt, Artificial Sequence
  Synthetic
gaucccgccacugcacuccagc

SEQ ID NO: 23105 - RNA, 23 nt, Artificial Sequence
  Synthetic
agaucccgccacugcacuccagc

SEQ ID NO: 23106 - RNA, 24 nt, Artificial Sequence
  Synthetic
gagaucccgccacugcacuccagc

SEQ ID NO: 23107 - RNA, 18 nt, Artificial Sequence
  Synthetic
caggagaauugcuugagc

SEQ ID NO: 23108 - RNA, 19 nt, Artificial Sequence
  Synthetic
gcaggagaauugcuugagc

SEQ ID NO: 23109 - RNA, 20 nt, Artificial Sequence
  Synthetic
ggcaggagaauugcuugagc

SEQ ID NO: 23110 - RNA, 21 nt, Artificial Sequence
  Synthetic
aggcaggagaauugcuugagc

SEQ ID NO: 23111 - RNA, 22 nt, Artificial Sequence
  Synthetic
gaggcaggagaauugcuugagc

SEQ ID NO: 23112 - RNA, 23 nt, Artificial Sequence
  Synthetic
ugaggcaggagaauugcuugagc

SEQ ID NO: 23113 - RNA, 24 nt, Artificial Sequence
  Synthetic
gugaggcaggagaauugcuugagc

SEQ ID NO: 23114 - RNA, 21 nt, Artificial Sequence
  Synthetic
caccucagccucccaaguagc

SEQ ID NO: 23115 - RNA, 22 nt, Artificial Sequence
  Synthetic
ccaccucagccucccaaguagc

SEQ ID NO: 23116 - RNA, 23 nt, Artificial Sequence
  Synthetic
cccaccucagccucccaaguagc

SEQ ID NO: 23117 - RNA, 24 nt, Artificial Sequence
  Synthetic
ucccaccucagccucccaaguagc

SEQ ID NO: 23118 - RNA, 18 nt, Artificial Sequence
  Synthetic
cucagccucccgaguagc

SEQ ID NO: 23119 - RNA, 19 nt, Artificial Sequence
  Synthetic
ccucagccucccgaguagc

SEQ ID NO: 23120 - RNA, 21 nt, Artificial Sequence
  Synthetic
ugccucagccucccgaguagc

SEQ ID NO: 23121 - RNA, 22 nt, Artificial Sequence
  Synthetic
cugccucagccucccgaguagc

SEQ ID NO: 23122 - RNA, 23 nt, Artificial Sequence
  Synthetic
ccugccucagccucccgaguagc

SEQ ID NO: 23123 - RNA, 24 nt, Artificial Sequence
  Synthetic
uccugccucagccucccgaguagc

SEQ ID NO: 23124 - RNA, 18 nt, Artificial Sequence
  Synthetic
aaacucauaagggaccgc

SEQ ID NO: 23125 - RNA, 19 nt, Artificial Sequence
  Synthetic
aaaacucauaagggaccgc

SEQ ID NO: 23126 - RNA, 20 nt, Artificial Sequence
  Synthetic
gaaaacucauaagggaccgc

SEQ ID NO: 23127 - RNA, 21 nt, Artificial Sequence
  Synthetic
agaaaacucauaagggaccgc

SEQ ID NO: 23128 - RNA, 22 nt, Artificial Sequence
  Synthetic
gagaaaacucauaagggaccgc

SEQ ID NO: 23129 - RNA, 23 nt, Artificial Sequence
  Synthetic
agagaaaacucauaagggaccgc

SEQ ID NO: 23130 - RNA, 24 nt, Artificial Sequence
  Synthetic
uagagaaaacucauaagggaccgc

SEQ ID NO: 23131 - RNA, 18 nt, Artificial Sequence
  Synthetic
ucucacaguucuggaggc

SEQ ID NO: 23132 - RNA, 19 nt, Artificial Sequence
  Synthetic
uucucacaguucuggaggc

SEQ ID NO: 23133 - RNA, 21 nt, Artificial Sequence
  Synthetic
auuucucacaguucuggaggc

SEQ ID NO: 23134 - RNA, 22 nt, Artificial Sequence
  Synthetic
uauuucucacaguucuggaggc

SEQ ID NO: 23135 - RNA, 23 nt, Artificial Sequence
  Synthetic
uuauuucucacaguucuggaggc

SEQ ID NO: 23136 - RNA, 24 nt, Artificial Sequence
  Synthetic
uuuauuucucacaguucuggaggc

SEQ ID NO: 23137 - RNA, 18 nt, Artificial Sequence
  Synthetic
uacuugggaggcugaggc

SEQ ID NO: 23138 - RNA, 19 nt, Artificial Sequence
  Synthetic
cuacuugggaggcugaggc

SEQ ID NO: 23139 - RNA, 21 nt, Artificial Sequence
  Synthetic
agcuacuugggaggcugaggc

SEQ ID NO: 23140 - RNA, 22 nt, Artificial Sequence
  Synthetic
cagcuacuugggaggcugaggc

SEQ ID NO: 23141 - RNA, 23 nt, Artificial Sequence
  Synthetic
ccagcuacuugggaggcugaggc

SEQ ID NO: 23142 - RNA, 24 nt, Artificial Sequence
  Synthetic
cccagcuacuugggaggcugaggc

SEQ ID NO: 23143 - RNA, 18 nt, Artificial Sequence
  Synthetic
uacuugggagggugaggc

SEQ ID NO: 23144 - RNA, 19 nt, Artificial Sequence
  Synthetic
cuacuugggagggugaggc

SEQ ID NO: 23145 - RNA, 21 nt, Artificial Sequence
  Synthetic
agcuacuugggagggugaggc

SEQ ID NO: 23146 - RNA, 22 nt, Artificial Sequence
  Synthetic
cagcuacuugggagggugaggc

SEQ ID NO: 23147 - RNA, 23 nt, Artificial Sequence
  Synthetic
ccagcuacuugggagggugaggc

SEQ ID NO: 23148 - RNA, 24 nt, Artificial Sequence
  Synthetic
cccagcuacuugggagggugaggc

SEQ ID NO: 23149 - RNA, 18 nt, Artificial Sequence
  Synthetic
cugaggcaggagaauggc

SEQ ID NO: 23150 - RNA, 19 nt, Artificial Sequence
  Synthetic
gcugaggcaggagaauggc

SEQ ID NO: 23151 - RNA, 20 nt, Artificial Sequence
  Synthetic
ggcugaggcaggagaauggc

SEQ ID NO: 23152 - RNA, 21 nt, Artificial Sequence
  Synthetic
aggcugaggcaggagaauggc

SEQ ID NO: 23153 - RNA, 22 nt, Artificial Sequence
  Synthetic
gaggcugaggcaggagaauggc

SEQ ID NO: 23154 - RNA, 23 nt, Artificial Sequence
  Synthetic
ggaggcugaggcaggagaauggc

SEQ ID NO: 23155 - RNA, 24 nt, Artificial Sequence
  Synthetic
gggaggcugaggcaggagaauggc

SEQ ID NO: 23156 - RNA, 18 nt, Artificial Sequence
  Synthetic
uuucaacauaugaauggc

SEQ ID NO: 23157 - RNA, 19 nt, Artificial Sequence
  Synthetic
auuucaacauaugaauggc

SEQ ID NO: 23158 - RNA, 21 nt, Artificial Sequence
  Synthetic
ggauuucaacauaugaauggc

SEQ ID NO: 23159 - RNA, 22 nt, Artificial Sequence
  Synthetic
aggauuucaacauaugaauggc

SEQ ID NO: 23160 - RNA, 23 nt, Artificial Sequence
  Synthetic
uaggauuucaacauaugaauggc

SEQ ID NO: 23161 - RNA, 24 nt, Artificial Sequence
  Synthetic
uuaggauuucaacauaugaauggc

SEQ ID NO: 23162 - RNA, 18 nt, Artificial Sequence
  Synthetic
aauggcuauccacaaugc

SEQ ID NO: 23163 - RNA, 19 nt, Artificial Sequence
  Synthetic
aaauggcuauccacaaugc

SEQ ID NO: 23164 - RNA, 20 nt, Artificial Sequence
  Synthetic
uaaauggcuauccacaaugc

SEQ ID NO: 23165 - RNA, 21 nt, Artificial Sequence
  Synthetic
uuaaauggcuauccacaaugc

SEQ ID NO: 23166 - RNA, 22 nt, Artificial Sequence
  Synthetic
uuuaaauggcuauccacaaugc

SEQ ID NO: 23167 - RNA, 23 nt, Artificial Sequence
  Synthetic
uuuuaaauggcuauccacaaugc

SEQ ID NO: 23168 - RNA, 24 nt, Artificial Sequence
  Synthetic
guuuuaaauggcuauccacaaugc

SEQ ID NO: 23169 - RNA, 18 nt, Artificial Sequence
  Synthetic
gguuggaugagggaaugc

SEQ ID NO: 23170 - RNA, 19 nt, Artificial Sequence
  Synthetic
ugguuggaugagggaaugc

SEQ ID NO: 23171 - RNA, 21 nt, Artificial Sequence
  Synthetic
cuugguuggaugagggaaugc

SEQ ID NO: 23172 - RNA, 22 nt, Artificial Sequence
  Synthetic
ccuugguuggaugagggaaugc

SEQ ID NO: 23173 - RNA, 23 nt, Artificial Sequence
  Synthetic
accuugguuggaugagggaaugc

SEQ ID NO: 23174 - RNA, 24 nt, Artificial Sequence
  Synthetic
uaccuugguuggaugagggaaugc

SEQ ID NO: 23175 - RNA, 18 nt, Artificial Sequence
  Synthetic
acaugaugaaaaauaugc

SEQ ID NO: 23176 - RNA, 19 nt, Artificial Sequence
  Synthetic
aacaugaugaaaaauaugc

SEQ ID NO: 23177 - RNA, 20 nt, Artificial Sequence
  Synthetic
aaacaugaugaaaaauaugc

SEQ ID NO: 23178 - RNA, 21 nt, Artificial Sequence
  Synthetic
uaaacaugaugaaaaauaugc

SEQ ID NO: 23179 - RNA, 22 nt, Artificial Sequence
  Synthetic
cuaaacaugaugaaaaauaugc

SEQ ID NO: 23180 - RNA, 23 nt, Artificial Sequence
  Synthetic
acuaaacaugaugaaaaauaugc

SEQ ID NO: 23181 - RNA, 24 nt, Artificial Sequence
  Synthetic
cacuaaacaugaugaaaaauaugc

SEQ ID NO: 23182 - RNA, 18 nt, Artificial Sequence
  Synthetic
caauuuuaauaaaacugc

SEQ ID NO: 23183 - RNA, 19 nt, Artificial Sequence
  Synthetic
ucaauuuuaauaaaacugc

SEQ ID NO: 23184 - RNA, 20 nt, Artificial Sequence
  Synthetic
aucaauuuuaauaaaacugc

SEQ ID NO: 23185 - RNA, 21 nt, Artificial Sequence
  Synthetic
caucaauuuuaauaaaacugc

SEQ ID NO: 23186 - RNA, 22 nt, Artificial Sequence
  Synthetic
ucaucaauuuuaauaaaacugc

SEQ ID NO: 23187 - RNA, 23 nt, Artificial Sequence
  Synthetic
cucaucaauuuuaauaaaacugc

SEQ ID NO: 23188 - RNA, 24 nt, Artificial Sequence
  Synthetic
gcucaucaauuuuaauaaaacugc

SEQ ID NO: 23189 - RNA, 18 nt, Artificial Sequence
  Synthetic
gugaggcaggagaauugc

SEQ ID NO: 23190 - RNA, 19 nt, Artificial Sequence
  Synthetic
ggugaggcaggagaauugc

SEQ ID NO: 23191 - RNA, 20 nt, Artificial Sequence
  Synthetic
gggugaggcaggagaauugc

SEQ ID NO: 23192 - RNA, 21 nt, Artificial Sequence
  Synthetic
agggugaggcaggagaauugc

SEQ ID NO: 23193 - RNA, 22 nt, Artificial Sequence
  Synthetic
gagggugaggcaggagaauugc

SEQ ID NO: 23194 - RNA, 23 nt, Artificial Sequence
  Synthetic
ggagggugaggcaggagaauugc

SEQ ID NO: 23195 - RNA, 24 nt, Artificial Sequence
  Synthetic
gggagggugaggcaggagaauugc

SEQ ID NO: 23196 - RNA, 18 nt, Artificial Sequence
  Synthetic
gccaccaucaucacuugc

SEQ ID NO: 23197 - RNA, 19 nt, Artificial Sequence
  Synthetic
agccaccaucaucacuugc

SEQ ID NO: 23198 - RNA, 20 nt, Artificial Sequence
  Synthetic
aagccaccaucaucacuugc

SEQ ID NO: 23199 - RNA, 21 nt, Artificial Sequence
  Synthetic
caagccaccaucaucacuugc

SEQ ID NO: 23200 - RNA, 22 nt, Artificial Sequence
  Synthetic
ucaagccaccaucaucacuugc

SEQ ID NO: 23201 - RNA, 23 nt, Artificial Sequence
  Synthetic
aucaagccaccaucaucacuugc

SEQ ID NO: 23202 - RNA, 24 nt, Artificial Sequence
  Synthetic
gaucaagccaccaucaucacuugc

SEQ ID NO: 23203 - RNA, 18 nt, Artificial Sequence
  Synthetic
acaaaguaacagaaaauc

SEQ ID NO: 23204 - RNA, 19 nt, Artificial Sequence
  Synthetic
aacaaaguaacagaaaauc

SEQ ID NO: 23205 - RNA, 20 nt, Artificial Sequence
  Synthetic
uaacaaaguaacagaaaauc

SEQ ID NO: 23206 - RNA, 21 nt, Artificial Sequence
  Synthetic
guaacaaaguaacagaaaauc

SEQ ID NO: 23207 - RNA, 22 nt, Artificial Sequence
  Synthetic
aguaacaaaguaacagaaaauc

SEQ ID NO: 23208 - RNA, 23 nt, Artificial Sequence
  Synthetic
aaguaacaaaguaacagaaaauc

SEQ ID NO: 23209 - RNA, 24 nt, Artificial Sequence
  Synthetic
aaaguaacaaaguaacagaaaauc

SEQ ID NO: 23210 - RNA, 18 nt, Artificial Sequence
  Synthetic
ugcuauuuaaacagaauc

SEQ ID NO: 23211 - RNA, 19 nt, Artificial Sequence
  Synthetic
gugcuauuuaaacagaauc

SEQ ID NO: 23212 - RNA, 21 nt, Artificial Sequence
  Synthetic
cagugcuauuuaaacagaauc

SEQ ID NO: 23213 - RNA, 22 nt, Artificial Sequence
  Synthetic
ccagugcuauuuaaacagaauc

SEQ ID NO: 23214 - RNA, 23 nt, Artificial Sequence
  Synthetic
uccagugcuauuuaaacagaauc

SEQ ID NO: 23215 - RNA, 24 nt, Artificial Sequence
  Synthetic
cuccagugcuauuuaaacagaauc

SEQ ID NO: 23216 - RNA, 18 nt, Artificial Sequence
  Synthetic
uuuaguagaaaccuaauc

SEQ ID NO: 23217 - RNA, 19 nt, Artificial Sequence
  Synthetic
uuuuaguagaaaccuaauc

SEQ ID NO: 23218 - RNA, 21 nt, Artificial Sequence
  Synthetic
gguuuuaguagaaaccuaauc

SEQ ID NO: 23219 - RNA, 22 nt, Artificial Sequence
  Synthetic
ugguuuuaguagaaaccuaauc

SEQ ID NO: 23220 - RNA, 23 nt, Artificial Sequence
  Synthetic
uugguuuuaguagaaaccuaauc

SEQ ID NO: 23221 - RNA, 24 nt, Artificial Sequence
  Synthetic
uuugguuuuaguagaaaccuaauc

SEQ ID NO: 23222 - RNA, 18 nt, Artificial Sequence
  Synthetic
ggccgaggcaggcagauc

SEQ ID NO: 23223 - RNA, 19 nt, Artificial Sequence
  Synthetic
aggccgaggcaggcagauc

SEQ ID NO: 23224 - RNA, 20 nt, Artificial Sequence
  Synthetic
gaggccgaggcaggcagauc

SEQ ID NO: 23225 - RNA, 21 nt, Artificial Sequence
  Synthetic
ggaggccgaggcaggcagauc

SEQ ID NO: 23226 - RNA, 22 nt, Artificial Sequence
  Synthetic
gggaggccgaggcaggcagauc

SEQ ID NO: 23227 - RNA, 23 nt, Artificial Sequence
  Synthetic
ugggaggccgaggcaggcagauc

SEQ ID NO: 23228 - RNA, 24 nt, Artificial Sequence
  Synthetic
uugggaggccgaggcaggcagauc

SEQ ID NO: 23229 - RNA, 18 nt, Artificial Sequence
  Synthetic
ggccgaggcgggcggauc

SEQ ID NO: 23230 - RNA, 19 nt, Artificial Sequence
  Synthetic
aggccgaggcgggcggauc

SEQ ID NO: 23231 - RNA, 20 nt, Artificial Sequence
  Synthetic
gaggccgaggcgggcggauc

SEQ ID NO: 23232 - RNA, 21 nt, Artificial Sequence
  Synthetic
ggaggccgaggcgggcggauc

SEQ ID NO: 23233 - RNA, 22 nt, Artificial Sequence
  Synthetic
gggaggccgaggcgggcggauc

SEQ ID NO: 23234 - RNA, 23 nt, Artificial Sequence
  Synthetic
ugggaggccgaggcgggcggauc

SEQ ID NO: 23235 - RNA, 24 nt, Artificial Sequence
  Synthetic
uugggaggccgaggcgggcggauc

SEQ ID NO: 23236 - RNA, 18 nt, Artificial Sequence
  Synthetic
ucuaucauagaauugauc

SEQ ID NO: 23237 - RNA, 19 nt, Artificial Sequence
  Synthetic
aucuaucauagaauugauc

SEQ ID NO: 23238 - RNA, 20 nt, Artificial Sequence
  Synthetic
caucuaucauagaauugauc

SEQ ID NO: 23239 - RNA, 21 nt, Artificial Sequence
  Synthetic
acaucuaucauagaauugauc

SEQ ID NO: 23240 - RNA, 22 nt, Artificial Sequence
  Synthetic
cacaucuaucauagaauugauc

SEQ ID NO: 23241 - RNA, 23 nt, Artificial Sequence
  Synthetic
gcacaucuaucauagaauugauc

SEQ ID NO: 23242 - RNA, 24 nt, Artificial Sequence
  Synthetic
ugcacaucuaucauagaauugauc

SEQ ID NO: 23243 - RNA, 18 nt, Artificial Sequence
  Synthetic
auacuggguucauuuauc

SEQ ID NO: 23244 - RNA, 19 nt, Artificial Sequence
  Synthetic
uauacuggguucauuuauc

SEQ ID NO: 23245 - RNA, 20 nt, Artificial Sequence
  Synthetic
uuauacuggguucauuuauc

SEQ ID NO: 23246 - RNA, 21 nt, Artificial Sequence
  Synthetic
uuuauacuggguucauuuauc

SEQ ID NO: 23247 - RNA, 22 nt, Artificial Sequence
  Synthetic
cuuuauacuggguucauuuauc

SEQ ID NO: 23248 - RNA, 23 nt, Artificial Sequence
  Synthetic
ucuuuauacuggguucauuuauc

SEQ ID NO: 23249 - RNA, 24 nt, Artificial Sequence
  Synthetic
gucuuuauacuggguucauuuauc

SEQ ID NO: 23250 - RNA, 18 nt, Artificial Sequence
  Synthetic
cacgcuggucucaaacuc

SEQ ID NO: 23251 - RNA, 19 nt, Artificial Sequence
  Synthetic
ccacgcuggucucaaacuc

SEQ ID NO: 23252 - RNA, 20 nt, Artificial Sequence
  Synthetic
cccacgcuggucucaaacuc

SEQ ID NO: 23253 - RNA, 21 nt, Artificial Sequence
  Synthetic
gcccacgcuggucucaaacuc

SEQ ID NO: 23254 - RNA, 22 nt, Artificial Sequence
  Synthetic
ugcccacgcuggucucaaacuc

SEQ ID NO: 23255 - RNA, 23 nt, Artificial Sequence
  Synthetic
uugcccacgcuggucucaaacuc

SEQ ID NO: 23256 - RNA, 24 nt, Artificial Sequence
  Synthetic
guugcccacgcuggucucaaacuc

SEQ ID NO: 23257 - RNA, 18 nt, Artificial Sequence
  Synthetic
guauuagcaaguggacuc

SEQ ID NO: 23258 - RNA, 19 nt, Artificial Sequence
  Synthetic
uguauuagcaaguggacuc

SEQ ID NO: 23259 - RNA, 20 nt, Artificial Sequence
  Synthetic
uuguauuagcaaguggacuc

SEQ ID NO: 23260 - RNA, 21 nt, Artificial Sequence
  Synthetic
auuguauuagcaaguggacuc

SEQ ID NO: 23261 - RNA, 22 nt, Artificial Sequence
  Synthetic
aauuguauuagcaaguggacuc

SEQ ID NO: 23262 - RNA, 23 nt, Artificial Sequence
  Synthetic
caauuguauuagcaaguggacuc

SEQ ID NO: 23263 - RNA, 24 nt, Artificial Sequence
  Synthetic
ucaauuguauuagcaaguggacuc

SEQ ID NO: 23264 - RNA, 18 nt, Artificial Sequence
  Synthetic
acuaaagacuucacccuc

SEQ ID NO: 23265 - RNA, 19 nt, Artificial Sequence
  Synthetic
uacuaaagacuucacccuc

SEQ ID NO: 23266 - RNA, 20 nt, Artificial Sequence
  Synthetic
uuacuaaagacuucacccuc

SEQ ID NO: 23267 - RNA, 21 nt, Artificial Sequence
  Synthetic
uuuacuaaagacuucacccuc

SEQ ID NO: 23268 - RNA, 22 nt, Artificial Sequence
  Synthetic
auuuacuaaagacuucacccuc

SEQ ID NO: 23269 - RNA, 23 nt, Artificial Sequence
  Synthetic
cauuuacuaaagacuucacccuc

SEQ ID NO: 23270 - RNA, 24 nt, Artificial Sequence
  Synthetic
ucauuuacuaaagacuucacccuc

SEQ ID NO: 23271 - RNA, 18 nt, Artificial Sequence
  Synthetic
ccacccaauuuuuggcuc

SEQ ID NO: 23272 - RNA, 19 nt, Artificial Sequence
  Synthetic
cccacccaauuuuuggcuc

SEQ ID NO: 23273 - RNA, 20 nt, Artificial Sequence
  Synthetic
ccccacccaauuuuuggcuc

SEQ ID NO: 23274 - RNA, 21 nt, Artificial Sequence
  Synthetic
cccccacccaauuuuuggcuc

SEQ ID NO: 23275 - RNA, 22 nt, Artificial Sequence
  Synthetic
ucccccacccaauuuuuggcuc

SEQ ID NO: 23276 - RNA, 23 nt, Artificial Sequence
  Synthetic
cucccccacccaauuuuuggcuc

SEQ ID NO: 23277 - RNA, 24 nt, Artificial Sequence
  Synthetic
gcucccccacccaauuuuuggcuc

SEQ ID NO: 23278 - RNA, 18 nt, Artificial Sequence
  Synthetic
uauagagagaaacaucuc

SEQ ID NO: 23279 - RNA, 19 nt, Artificial Sequence
  Synthetic
auauagagagaaacaucuc

SEQ ID NO: 23280 - RNA, 21 nt, Artificial Sequence
  Synthetic
auauauagagagaaacaucuc

SEQ ID NO: 23281 - RNA, 22 nt, Artificial Sequence
  Synthetic
uauauauagagagaaacaucuc

SEQ ID NO: 23282 - RNA, 23 nt, Artificial Sequence
  Synthetic
auauauauagagagaaacaucuc

SEQ ID NO: 23283 - RNA, 24 nt, Artificial Sequence
  Synthetic
uauauauauagagagaaacaucuc

SEQ ID NO: 23284 - RNA, 18 nt, Artificial Sequence
  Synthetic
uuuaauugccaguaaguc

SEQ ID NO: 23285 - RNA, 19 nt, Artificial Sequence
  Synthetic
auuuaauugccaguaaguc

SEQ ID NO: 23286 - RNA, 20 nt, Artificial Sequence
  Synthetic
aauuuaauugccaguaaguc

SEQ ID NO: 23287 - RNA, 21 nt, Artificial Sequence
  Synthetic
aaauuuaauugccaguaaguc

SEQ ID NO: 23288 - RNA, 22 nt, Artificial Sequence
  Synthetic
gaaauuuaauugccaguaaguc

SEQ ID NO: 23289 - RNA, 23 nt, Artificial Sequence
  Synthetic
ugaaauuuaauugccaguaaguc

SEQ ID NO: 23290 - RNA, 24 nt, Artificial Sequence
  Synthetic
cugaaauuuaauugccaguaaguc

SEQ ID NO: 23291 - RNA, 18 nt, Artificial Sequence
  Synthetic
ccuuccaguuacucaguc

SEQ ID NO: 23292 - RNA, 19 nt, Artificial Sequence
  Synthetic
uccuuccaguuacucaguc

SEQ ID NO: 23293 - RNA, 20 nt, Artificial Sequence
  Synthetic
auccuuccaguuacucaguc

SEQ ID NO: 23294 - RNA, 21 nt, Artificial Sequence
  Synthetic
uauccuuccaguuacucaguc

SEQ ID NO: 23295 - RNA, 22 nt, Artificial Sequence
  Synthetic
uuauccuuccaguuacucaguc

SEQ ID NO: 23296 - RNA, 23 nt, Artificial Sequence
  Synthetic
uuuauccuuccaguuacucaguc

SEQ ID NO: 23297 - RNA, 24 nt, Artificial Sequence
  Synthetic
auuuauccuuccaguuacucaguc

SEQ ID NO: 23298 - RNA, 18 nt, Artificial Sequence
  Synthetic
auaagccagcuuucaguc

SEQ ID NO: 23299 - RNA, 19 nt, Artificial Sequence
  Synthetic
cauaagccagcuuucaguc

SEQ ID NO: 23300 - RNA, 20 nt, Artificial Sequence
  Synthetic
ccauaagccagcuuucaguc

SEQ ID NO: 23301 - RNA, 21 nt, Artificial Sequence
  Synthetic
gccauaagccagcuuucaguc

SEQ ID NO: 23302 - RNA, 22 nt, Artificial Sequence
  Synthetic
ugccauaagccagcuuucaguc

SEQ ID NO: 23303 - RNA, 23 nt, Artificial Sequence
  Synthetic
augccauaagccagcuuucaguc

SEQ ID NO: 23304 - RNA, 24 nt, Artificial Sequence
  Synthetic
gaugccauaagccagcuuucaguc

SEQ ID NO: 23305 - RNA, 18 nt, Artificial Sequence
  Synthetic
cgggcggaucacgagguc

SEQ ID NO: 23306 - RNA, 19 nt, Artificial Sequence
  Synthetic
gcgggcggaucacgagguc

SEQ ID NO: 23307 - RNA, 21 nt, Artificial Sequence
  Synthetic
aggcgggcggaucacgagguc

SEQ ID NO: 23308 - RNA, 22 nt, Artificial Sequence
  Synthetic
gaggcgggcggaucacgagguc

SEQ ID NO: 23309 - RNA, 23 nt, Artificial Sequence
  Synthetic
cgaggcgggcggaucacgagguc

SEQ ID NO: 23310 - RNA, 24 nt, Artificial Sequence
  Synthetic
ccgaggcgggcggaucacgagguc

SEQ ID NO: 23311 - RNA, 18 nt, Artificial Sequence
  Synthetic
caggcagaucaugagguc

SEQ ID NO: 23312 - RNA, 19 nt, Artificial Sequence
  Synthetic
gcaggcagaucaugagguc

SEQ ID NO: 23313 - RNA, 20 nt, Artificial Sequence
  Synthetic
ggcaggcagaucaugagguc

SEQ ID NO: 23314 - RNA, 21 nt, Artificial Sequence
  Synthetic
aggcaggcagaucaugagguc

SEQ ID NO: 23315 - RNA, 22 nt, Artificial Sequence
  Synthetic
gaggcaggcagaucaugagguc

SEQ ID NO: 23316 - RNA, 23 nt, Artificial Sequence
  Synthetic
cgaggcaggcagaucaugagguc

SEQ ID NO: 23317 - RNA, 24 nt, Artificial Sequence
  Synthetic
ccgaggcaggcagaucaugagguc

SEQ ID NO: 23318 - RNA, 18 nt, Artificial Sequence
  Synthetic
gcuucacuaaaauaauuc

SEQ ID NO: 23319 - RNA, 19 nt, Artificial Sequence
  Synthetic
ugcuucacuaaaauaauuc

SEQ ID NO: 23320 - RNA, 20 nt, Artificial Sequence
  Synthetic
uugcuucacuaaaauaauuc

SEQ ID NO: 23321 - RNA, 21 nt, Artificial Sequence
  Synthetic
auugcuucacuaaaauaauuc

SEQ ID NO: 23322 - RNA, 22 nt, Artificial Sequence
  Synthetic
uauugcuucacuaaaauaauuc

SEQ ID NO: 23323 - RNA, 23 nt, Artificial Sequence
  Synthetic
auauugcuucacuaaaauaauuc

SEQ ID NO: 23324 - RNA, 24 nt, Artificial Sequence
  Synthetic
aauauugcuucacuaaaauaauuc

SEQ ID NO: 23325 - RNA, 18 nt, Artificial Sequence
  Synthetic
gauuauucgguauaauuc

SEQ ID NO: 23326 - RNA, 19 nt, Artificial Sequence
  Synthetic
agauuauucgguauaauuc

SEQ ID NO: 23327 - RNA, 20 nt, Artificial Sequence
  Synthetic
uagauuauucgguauaauuc

SEQ ID NO: 23328 - RNA, 21 nt, Artificial Sequence
  Synthetic
uuagauuauucgguauaauuc

SEQ ID NO: 23329 - RNA, 22 nt, Artificial Sequence
  Synthetic
cuuagauuauucgguauaauuc

SEQ ID NO: 23330 - RNA, 23 nt, Artificial Sequence
  Synthetic
ucuuagauuauucgguauaauuc

SEQ ID NO: 23331 - RNA, 24 nt, Artificial Sequence
  Synthetic
gucuuagauuauucgguauaauuc

SEQ ID NO: 23332 - RNA, 18 nt, Artificial Sequence
  Synthetic
aaaucuaaaagcuaauuc

SEQ ID NO: 23333 - RNA, 19 nt, Artificial Sequence
  Synthetic
uaaaucuaaaagcuaauuc

SEQ ID NO: 23334 - RNA, 20 nt, Artificial Sequence
  Synthetic
guaaaucuaaaagcuaauuc

SEQ ID NO: 23335 - RNA, 21 nt, Artificial Sequence
  Synthetic
aguaaaucuaaaagcuaauuc

SEQ ID NO: 23336 - RNA, 22 nt, Artificial Sequence
  Synthetic
aaguaaaucuaaaagcuaauuc

SEQ ID NO: 23337 - RNA, 23 nt, Artificial Sequence
  Synthetic
uaaguaaaucuaaaagcuaauuc

SEQ ID NO: 23338 - RNA, 24 nt, Artificial Sequence
  Synthetic
auaaguaaaucuaaaagcuaauuc

SEQ ID NO: 23339 - RNA, 18 nt, Artificial Sequence
  Synthetic
auaauuugaacaacauuc

SEQ ID NO: 23340 - RNA, 19 nt, Artificial Sequence
  Synthetic
aauaauuugaacaacauuc

SEQ ID NO: 23341 - RNA, 20 nt, Artificial Sequence
  Synthetic
aaauaauuugaacaacauuc

SEQ ID NO: 23342 - RNA, 21 nt, Artificial Sequence
  Synthetic
gaaauaauuugaacaacauuc

SEQ ID NO: 23343 - RNA, 22 nt, Artificial Sequence
  Synthetic
agaaauaauuugaacaacauuc

SEQ ID NO: 23344 - RNA, 23 nt, Artificial Sequence
  Synthetic
uagaaauaauuugaacaacauuc

SEQ ID NO: 23345 - RNA, 24 nt, Artificial Sequence
  Synthetic
guagaaauaauuugaacaacauuc

SEQ ID NO: 23346 - RNA, 18 nt, Artificial Sequence
  Synthetic
auuuaaaaagcaauauuc

SEQ ID NO: 23347 - RNA, 19 nt, Artificial Sequence
  Synthetic
aauuuaaaaagcaauauuc

SEQ ID NO: 23348 - RNA, 20 nt, Artificial Sequence
  Synthetic
aaauuuaaaaagcaauauuc

SEQ ID NO: 23349 - RNA, 21 nt, Artificial Sequence
  Synthetic
uaaauuuaaaaagcaauauuc

SEQ ID NO: 23350 - RNA, 22 nt, Artificial Sequence
  Synthetic
uuaaauuuaaaaagcaauauuc

SEQ ID NO: 23351 - RNA, 23 nt, Artificial Sequence
  Synthetic
auuaaauuuaaaaagcaauauuc

SEQ ID NO: 23352 - RNA, 24 nt, Artificial Sequence
  Synthetic
uauuaaauuuaaaaagcaauauuc

SEQ ID NO: 23353 - RNA, 18 nt, Artificial Sequence
  Synthetic
acacaauggguuauauuc

SEQ ID NO: 23354 - RNA, 19 nt, Artificial Sequence
  Synthetic
uacacaauggguuauauuc

SEQ ID NO: 23355 - RNA, 20 nt, Artificial Sequence
  Synthetic
cuacacaauggguuauauuc

SEQ ID NO: 23356 - RNA, 21 nt, Artificial Sequence
  Synthetic
ucuacacaauggguuauauuc

SEQ ID NO: 23357 - RNA, 22 nt, Artificial Sequence
  Synthetic
aucuacacaauggguuauauuc

SEQ ID NO: 23358 - RNA, 23 nt, Artificial Sequence
  Synthetic
uaucuacacaauggguuauauuc

SEQ ID NO: 23359 - RNA, 24 nt, Artificial Sequence
  Synthetic
uuaucuacacaauggguuauauuc

SEQ ID NO: 23360 - RNA, 18 nt, Artificial Sequence
  Synthetic
aguauuuugaaaagcuuc

SEQ ID NO: 23361 - RNA, 19 nt, Artificial Sequence
  Synthetic
aaguauuuugaaaagcuuc

SEQ ID NO: 23362 - RNA, 20 nt, Artificial Sequence
  Synthetic
aaaguauuuugaaaagcuuc

SEQ ID NO: 23363 - RNA, 21 nt, Artificial Sequence
  Synthetic
gaaaguauuuugaaaagcuuc

SEQ ID NO: 23364 - RNA, 22 nt, Artificial Sequence
  Synthetic
agaaaguauuuugaaaagcuuc

SEQ ID NO: 23365 - RNA, 23 nt, Artificial Sequence
  Synthetic
uagaaaguauuuugaaaagcuuc

SEQ ID NO: 23366 - RNA, 24 nt, Artificial Sequence
  Synthetic
cuagaaaguauuuugaaaagcuuc

SEQ ID NO: 23367 - RNA, 18 nt, Artificial Sequence
  Synthetic
auuuauuucucacaguuc

SEQ ID NO: 23368 - RNA, 19 nt, Artificial Sequence
  Synthetic
aauuuauuucucacaguuc

SEQ ID NO: 23369 - RNA, 21 nt, Artificial Sequence
  Synthetic
ggaauuuauuucucacaguuc

SEQ ID NO: 23370 - RNA, 22 nt, Artificial Sequence
  Synthetic
aggaauuuauuucucacaguuc

SEQ ID NO: 23371 - RNA, 23 nt, Artificial Sequence
  Synthetic
caggaauuuauuucucacaguuc

SEQ ID NO: 23372 - RNA, 24 nt, Artificial Sequence
  Synthetic
acaggaauuuauuucucacaguuc

SEQ ID NO: 23373 - RNA, 18 nt, Artificial Sequence
  Synthetic
cgaauugguacaaauuuc

SEQ ID NO: 23374 - RNA, 19 nt, Artificial Sequence
  Synthetic
acgaauugguacaaauuuc

SEQ ID NO: 23375 - RNA, 21 nt, Artificial Sequence
  Synthetic
guacgaauugguacaaauuuc

SEQ ID NO: 23376 - RNA, 22 nt, Artificial Sequence
  Synthetic
aguacgaauugguacaaauuuc

SEQ ID NO: 23377 - RNA, 23 nt, Artificial Sequence
  Synthetic
gaguacgaauugguacaaauuuc

SEQ ID NO: 23378 - RNA, 24 nt, Artificial Sequence
  Synthetic
ugaguacgaauugguacaaauuuc

SEQ ID NO: 23379 - RNA, 18 nt, Artificial Sequence
  Synthetic
gaaaauuuguuuucuuuc

SEQ ID NO: 23380 - RNA, 19 nt, Artificial Sequence
  Synthetic
agaaaauuuguuuucuuuc

SEQ ID NO: 23381 - RNA, 21 nt, Artificial Sequence
  Synthetic
aaagaaaauuuguuuucuuuc

SEQ ID NO: 23382 - RNA, 22 nt, Artificial Sequence
  Synthetic
caaagaaaauuuguuuucuuuc

SEQ ID NO: 23383 - RNA, 23 nt, Artificial Sequence
  Synthetic
acaaagaaaauuuguuuucuuuc

SEQ ID NO: 23384 - RNA, 24 nt, Artificial Sequence
  Synthetic
aacaaagaaaauuuguuuucuuuc

SEQ ID NO: 23385 - RNA, 18 nt, Artificial Sequence
  Synthetic
ucaaagcuacagauuuuc

SEQ ID NO: 23386 - RNA, 19 nt, Artificial Sequence
  Synthetic
aucaaagcuacagauuuuc

SEQ ID NO: 23387 - RNA, 20 nt, Artificial Sequence
  Synthetic
aaucaaagcuacagauuuuc

SEQ ID NO: 23388 - RNA, 21 nt, Artificial Sequence
  Synthetic
aaaucaaagcuacagauuuuc

SEQ ID NO: 23389 - RNA, 22 nt, Artificial Sequence
  Synthetic
uaaaucaaagcuacagauuuuc

SEQ ID NO: 23390 - RNA, 23 nt, Artificial Sequence
  Synthetic
auaaaucaaagcuacagauuuuc

SEQ ID NO: 23391 - RNA, 24 nt, Artificial Sequence
  Synthetic
uauaaaucaaagcuacagauuuuc

SEQ ID NO: 23392 - RNA, 18 nt, Artificial Sequence
  Synthetic
uugcuuuauuaagaaaag

SEQ ID NO: 23393 - RNA, 19 nt, Artificial Sequence
  Synthetic
auugcuuuauuaagaaaag

SEQ ID NO: 23394 - RNA, 20 nt, Artificial Sequence
  Synthetic
gauugcuuuauuaagaaaag

SEQ ID NO: 23395 - RNA, 21 nt, Artificial Sequence
  Synthetic
ugauugcuuuauuaagaaaag

SEQ ID NO: 23396 - RNA, 22 nt, Artificial Sequence
  Synthetic
cugauugcuuuauuaagaaaag

SEQ ID NO: 23397 - RNA, 23 nt, Artificial Sequence
  Synthetic
gcugauugcuuuauuaagaaaag

SEQ ID NO: 23398 - RNA, 24 nt, Artificial Sequence
  Synthetic
ugcugauugcuuuauuaagaaaag

SEQ ID NO: 23399 - RNA, 18 nt, Artificial Sequence
  Synthetic
ggauaucuuaggucaaag

SEQ ID NO: 23400 - RNA, 19 nt, Artificial Sequence
  Synthetic
aggauaucuuaggucaaag

SEQ ID NO: 23401 - RNA, 21 nt, Artificial Sequence
  Synthetic
uuaggauaucuuaggucaaag

SEQ ID NO: 23402 - RNA, 22 nt, Artificial Sequence
  Synthetic
cuuaggauaucuuaggucaaag

SEQ ID NO: 23403 - RNA, 23 nt, Artificial Sequence
  Synthetic
ccuuaggauaucuuaggucaaag

SEQ ID NO: 23404 - RNA, 24 nt, Artificial Sequence
  Synthetic
cccuuaggauaucuuaggucaaag

SEQ ID NO: 23405 - RNA, 18 nt, Artificial Sequence
  Synthetic
uguuaauggcaaagcaag

SEQ ID NO: 23406 - RNA, 19 nt, Artificial Sequence
  Synthetic
cuguuaauggcaaagcaag

SEQ ID NO: 23407 - RNA, 20 nt, Artificial Sequence
  Synthetic
ucuguuaauggcaaagcaag

SEQ ID NO: 23408 - RNA, 21 nt, Artificial Sequence
  Synthetic
aucuguuaauggcaaagcaag

SEQ ID NO: 23409 - RNA, 22 nt, Artificial Sequence
  Synthetic
uaucuguuaauggcaaagcaag

SEQ ID NO: 23410 - RNA, 23 nt, Artificial Sequence
  Synthetic
uuaucuguuaauggcaaagcaag

SEQ ID NO: 23411 - RNA, 24 nt, Artificial Sequence
  Synthetic
uuuaucuguuaauggcaaagcaag

SEQ ID NO: 23412 - RNA, 18 nt, Artificial Sequence
  Synthetic
uuggguaaguuauagaag

SEQ ID NO: 23413 - RNA, 19 nt, Artificial Sequence
  Synthetic
uuuggguaaguuauagaag

SEQ ID NO: 23414 - RNA, 20 nt, Artificial Sequence
  Synthetic
auuuggguaaguuauagaag

SEQ ID NO: 23415 - RNA, 21 nt, Artificial Sequence
  Synthetic
uauuuggguaaguuauagaag

SEQ ID NO: 23416 - RNA, 22 nt, Artificial Sequence
  Synthetic
auauuuggguaaguuauagaag

SEQ ID NO: 23417 - RNA, 23 nt, Artificial Sequence
  Synthetic
cauauuuggguaaguuauagaag

SEQ ID NO: 23418 - RNA, 24 nt, Artificial Sequence
  Synthetic
acauauuuggguaaguuauagaag

SEQ ID NO: 23419 - RNA, 18 nt, Artificial Sequence
  Synthetic
cacuuugggaggcugaag

SEQ ID NO: 23420 - RNA, 19 nt, Artificial Sequence
  Synthetic
gcacuuugggaggcugaag

SEQ ID NO: 23421 - RNA, 21 nt, Artificial Sequence
  Synthetic
cagcacuuugggaggcugaag

SEQ ID NO: 23422 - RNA, 22 nt, Artificial Sequence
  Synthetic
ccagcacuuugggaggcugaag

SEQ ID NO: 23423 - RNA, 23 nt, Artificial Sequence
  Synthetic
cccagcacuuugggaggcugaag

SEQ ID NO: 23424 - RNA, 24 nt, Artificial Sequence
  Synthetic
acccagcacuuugggaggcugaag

SEQ ID NO: 23425 - RNA, 18 nt, Artificial Sequence
  Synthetic
uacuauuuucccuauaag

SEQ ID NO: 23426 - RNA, 19 nt, Artificial Sequence
  Synthetic
auacuauuuucccuauaag

SEQ ID NO: 23427 - RNA, 20 nt, Artificial Sequence
  Synthetic
cauacuauuuucccuauaag

SEQ ID NO: 23428 - RNA, 21 nt, Artificial Sequence
  Synthetic
acauacuauuuucccuauaag

SEQ ID NO: 23429 - RNA, 22 nt, Artificial Sequence
  Synthetic
gacauacuauuuucccuauaag

SEQ ID NO: 23430 - RNA, 23 nt, Artificial Sequence
  Synthetic
ugacauacuauuuucccuauaag

SEQ ID NO: 23431 - RNA, 24 nt, Artificial Sequence
  Synthetic
uugacauacuauuuucccuauaag

SEQ ID NO: 23432 - RNA, 18 nt, Artificial Sequence
  Synthetic
auuccuccuguguauaag

SEQ ID NO: 23433 - RNA, 19 nt, Artificial Sequence
  Synthetic
aauuccuccuguguauaag

SEQ ID NO: 23434 - RNA, 20 nt, Artificial Sequence
  Synthetic
aaauuccuccuguguauaag

SEQ ID NO: 23435 - RNA, 21 nt, Artificial Sequence
  Synthetic
gaaauuccuccuguguauaag

SEQ ID NO: 23436 - RNA, 22 nt, Artificial Sequence
  Synthetic
agaaauuccuccuguguauaag

SEQ ID NO: 23437 - RNA, 23 nt, Artificial Sequence
  Synthetic
gagaaauuccuccuguguauaag

SEQ ID NO: 23438 - RNA, 24 nt, Artificial Sequence
  Synthetic
agagaaauuccuccuguguauaag

SEQ ID NO: 23439 - RNA, 18 nt, Artificial Sequence
  Synthetic
cuuaacccaucuauuaag

SEQ ID NO: 23440 - RNA, 19 nt, Artificial Sequence
  Synthetic
gcuuaacccaucuauuaag

SEQ ID NO: 23441 - RNA, 21 nt, Artificial Sequence
  Synthetic
uggcuuaacccaucuauuaag

SEQ ID NO: 23442 - RNA, 22 nt, Artificial Sequence
  Synthetic
uuggcuuaacccaucuauuaag

SEQ ID NO: 23443 - RNA, 23 nt, Artificial Sequence
  Synthetic
guuggcuuaacccaucuauuaag

SEQ ID NO: 23444 - RNA, 24 nt, Artificial Sequence
  Synthetic
aguuggcuuaacccaucuauuaag

SEQ ID NO: 23445 - RNA, 18 nt, Artificial Sequence
  Synthetic
cugugaugcagacaacag

SEQ ID NO: 23446 - RNA, 19 nt, Artificial Sequence
  Synthetic
gcugugaugcagacaacag

SEQ ID NO: 23447 - RNA, 20 nt, Artificial Sequence
  Synthetic
agcugugaugcagacaacag

SEQ ID NO: 23448 - RNA, 21 nt, Artificial Sequence
  Synthetic
cagcugugaugcagacaacag

SEQ ID NO: 23449 - RNA, 22 nt, Artificial Sequence
  Synthetic
ucagcugugaugcagacaacag

SEQ ID NO: 23450 - RNA, 23 nt, Artificial Sequence
  Synthetic
uucagcugugaugcagacaacag

SEQ ID NO: 23451 - RNA, 24 nt, Artificial Sequence
  Synthetic
cuucagcugugaugcagacaacag

SEQ ID NO: 23452 - RNA, 18 nt, Artificial Sequence
  Synthetic
agaauggaaaauggacag

SEQ ID NO: 23453 - RNA, 19 nt, Artificial Sequence
  Synthetic
gagaauggaaaauggacag

SEQ ID NO: 23454 - RNA, 20 nt, Artificial Sequence
  Synthetic
ggagaauggaaaauggacag

SEQ ID NO: 23455 - RNA, 21 nt, Artificial Sequence
  Synthetic
aggagaauggaaaauggacag

SEQ ID NO: 23456 - RNA, 22 nt, Artificial Sequence
  Synthetic
caggagaauggaaaauggacag

SEQ ID NO: 23457 - RNA, 23 nt, Artificial Sequence
  Synthetic
gcaggagaauggaaaauggacag

SEQ ID NO: 23458 - RNA, 24 nt, Artificial Sequence
  Synthetic
ugcaggagaauggaaaauggacag

SEQ ID NO: 23459 - RNA, 18 nt, Artificial Sequence
  Synthetic
agcuaaaguauuacccag

SEQ ID NO: 23460 - RNA, 19 nt, Artificial Sequence
  Synthetic
cagcuaaaguauuacccag

SEQ ID NO: 23461 - RNA, 21 nt, Artificial Sequence
  Synthetic
uacagcuaaaguauuacccag

SEQ ID NO: 23462 - RNA, 22 nt, Artificial Sequence
  Synthetic
auacagcuaaaguauuacccag

SEQ ID NO: 23463 - RNA, 23 nt, Artificial Sequence
  Synthetic
uauacagcuaaaguauuacccag

SEQ ID NO: 23464 - RNA, 24 nt, Artificial Sequence
  Synthetic
auauacagcuaaaguauuacccag

SEQ ID NO: 23465 - RNA, 18 nt, Artificial Sequence
  Synthetic
gauaaaaauuccaagcag

SEQ ID NO: 23466 - RNA, 19 nt, Artificial Sequence
  Synthetic
ugauaaaaauuccaagcag

SEQ ID NO: 23467 - RNA, 20 nt, Artificial Sequence
  Synthetic
augauaaaaauuccaagcag

SEQ ID NO: 23468 - RNA, 21 nt, Artificial Sequence
  Synthetic
aaugauaaaaauuccaagcag

SEQ ID NO: 23469 - RNA, 22 nt, Artificial Sequence
  Synthetic
aaaugauaaaaauuccaagcag

SEQ ID NO: 23470 - RNA, 23 nt, Artificial Sequence
  Synthetic
aaaaugauaaaaauuccaagcag

SEQ ID NO: 23471 - RNA, 24 nt, Artificial Sequence
  Synthetic
aaaaaugauaaaaauuccaagcag

SEQ ID NO: 23472 - RNA, 18 nt, Artificial Sequence
  Synthetic
aaggaaaggagguagcag

SEQ ID NO: 23473 - RNA, 19 nt, Artificial Sequence
  Synthetic
gaaggaaaggagguagcag

SEQ ID NO: 23474 - RNA, 21 nt, Artificial Sequence
  Synthetic
uagaaggaaaggagguagcag

SEQ ID NO: 23475 - RNA, 22 nt, Artificial Sequence
  Synthetic
guagaaggaaaggagguagcag

SEQ ID NO: 23476 - RNA, 23 nt, Artificial Sequence
  Synthetic
aguagaaggaaaggagguagcag

SEQ ID NO: 23477 - RNA, 24 nt, Artificial Sequence
  Synthetic
gaguagaaggaaaggagguagcag

SEQ ID NO: 23478 - RNA, 18 nt, Artificial Sequence
  Synthetic
ucaacauaugaauggcag

SEQ ID NO: 23479 - RNA, 19 nt, Artificial Sequence
  Synthetic
uucaacauaugaauggcag

SEQ ID NO: 23480 - RNA, 21 nt, Artificial Sequence
  Synthetic
auuucaacauaugaauggcag

SEQ ID NO: 23481 - RNA, 22 nt, Artificial Sequence
  Synthetic
gauuucaacauaugaauggcag

SEQ ID NO: 23482 - RNA, 23 nt, Artificial Sequence
  Synthetic
ggauuucaacauaugaauggcag

SEQ ID NO: 23483 - RNA, 24 nt, Artificial Sequence
  Synthetic
aggauuucaacauaugaauggcag

SEQ ID NO: 23484 - RNA, 18 nt, Artificial Sequence
  Synthetic
cuauuuaaacagaaucag

SEQ ID NO: 23485 - RNA, 19 nt, Artificial Sequence
  Synthetic
gcuauuuaaacagaaucag

SEQ ID NO: 23486 - RNA, 21 nt, Artificial Sequence
  Synthetic
gugcuauuuaaacagaaucag

SEQ ID NO: 23487 - RNA, 22 nt, Artificial Sequence
  Synthetic
agugcuauuuaaacagaaucag

SEQ ID NO: 23488 - RNA, 23 nt, Artificial Sequence
  Synthetic
cagugcuauuuaaacagaaucag

SEQ ID NO: 23489 - RNA, 24 nt, Artificial Sequence
  Synthetic
ccagugcuauuuaaacagaaucag

SEQ ID NO: 23490 - RNA, 18 nt, Artificial Sequence
  Synthetic
cauaauaagacagcucag

SEQ ID NO: 23491 - RNA, 19 nt, Artificial Sequence
  Synthetic
acauaauaagacagcucag

SEQ ID NO: 23492 - RNA, 20 nt, Artificial Sequence
  Synthetic
aacauaauaagacagcucag

SEQ ID NO: 23493 - RNA, 21 nt, Artificial Sequence
  Synthetic
aaacauaauaagacagcucag

SEQ ID NO: 23494 - RNA, 22 nt, Artificial Sequence
  Synthetic
aaaacauaauaagacagcucag

SEQ ID NO: 23495 - RNA, 23 nt, Artificial Sequence
  Synthetic
caaaacauaauaagacagcucag

SEQ ID NO: 23496 - RNA, 24 nt, Artificial Sequence
  Synthetic
acaaaacauaauaagacagcucag

SEQ ID NO: 23497 - RNA, 18 nt, Artificial Sequence
  Synthetic
aagaggaaaagacuucag

SEQ ID NO: 23498 - RNA, 19 nt, Artificial Sequence
  Synthetic
uaagaggaaaagacuucag

SEQ ID NO: 23499 - RNA, 20 nt, Artificial Sequence
  Synthetic
uuaagaggaaaagacuucag

SEQ ID NO: 23500 - RNA, 21 nt, Artificial Sequence
  Synthetic
auuaagaggaaaagacuucag

SEQ ID NO: 23501 - RNA, 22 nt, Artificial Sequence
  Synthetic
uauuaagaggaaaagacuucag

SEQ ID NO: 23502 - RNA, 23 nt, Artificial Sequence
  Synthetic
cuauuaagaggaaaagacuucag

SEQ ID NO: 23503 - RNA, 24 nt, Artificial Sequence
  Synthetic
ucuauuaagaggaaaagacuucag

SEQ ID NO: 23504 - RNA, 18 nt, Artificial Sequence
  Synthetic
uguuacauaaaaagagag

SEQ ID NO: 23505 - RNA, 19 nt, Artificial Sequence
  Synthetic
uuguuacauaaaaagagag

SEQ ID NO: 23506 - RNA, 20 nt, Artificial Sequence
  Synthetic
auuguuacauaaaaagagag

SEQ ID NO: 23507 - RNA, 21 nt, Artificial Sequence
  Synthetic
uauuguuacauaaaaagagag

SEQ ID NO: 23508 - RNA, 22 nt, Artificial Sequence
  Synthetic
auauuguuacauaaaaagagag

SEQ ID NO: 23509 - RNA, 23 nt, Artificial Sequence
  Synthetic
cauauuguuacauaaaaagagag

SEQ ID NO: 23510 - RNA, 24 nt, Artificial Sequence
  Synthetic
gcauauuguuacauaaaaagagag

SEQ ID NO: 23511 - RNA, 18 nt, Artificial Sequence
  Synthetic
uuuguauuuuuaguagag

SEQ ID NO: 23512 - RNA, 19 nt, Artificial Sequence
  Synthetic
uuuuguauuuuuaguagag

SEQ ID NO: 23513 - RNA, 20 nt, Artificial Sequence
  Synthetic
uuuuuguauuuuuaguagag

SEQ ID NO: 23514 - RNA, 21 nt, Artificial Sequence
  Synthetic
uuuuuuguauuuuuaguagag

SEQ ID NO: 23515 - RNA, 22 nt, Artificial Sequence
  Synthetic
auuuuuuguauuuuuaguagag

SEQ ID NO: 23516 - RNA, 23 nt, Artificial Sequence
  Synthetic
aauuuuuuguauuuuuaguagag

SEQ ID NO: 23517 - RNA, 24 nt, Artificial Sequence
  Synthetic
uaauuuuuuguauuuuuaguagag

SEQ ID NO: 23518 - RNA, 18 nt, Artificial Sequence
  Synthetic
uuuguguuuuuuguagag

SEQ ID NO: 23519 - RNA, 19 nt, Artificial Sequence
  Synthetic
guuuguguuuuuuguagag

SEQ ID NO: 23520 - RNA, 20 nt, Artificial Sequence
  Synthetic
uguuuguguuuuuuguagag

SEQ ID NO: 23521 - RNA, 21 nt, Artificial Sequence
  Synthetic
uuguuuguguuuuuuguagag

SEQ ID NO: 23522 - RNA, 22 nt, Artificial Sequence
  Synthetic
uuuguuuguguuuuuuguagag

SEQ ID NO: 23523 - RNA, 23 nt, Artificial Sequence
  Synthetic
uuuuguuuguguuuuuuguagag

SEQ ID NO: 23524 - RNA, 24 nt, Artificial Sequence
  Synthetic
cuuuuguuuguguuuuuuguagag

SEQ ID NO: 23525 - RNA, 18 nt, Artificial Sequence
  Synthetic
gcacuuugggaggccgag

SEQ ID NO: 23526 - RNA, 19 nt, Artificial Sequence
  Synthetic
agcacuuugggaggccgag

SEQ ID NO: 23527 - RNA, 20 nt, Artificial Sequence
  Synthetic
cagcacuuugggaggccgag

SEQ ID NO: 23528 - RNA, 21 nt, Artificial Sequence
  Synthetic
ccagcacuuugggaggccgag

SEQ ID NO: 23529 - RNA, 22 nt, Artificial Sequence
  Synthetic
cccagcacuuugggaggccgag

SEQ ID NO: 23530 - RNA, 23 nt, Artificial Sequence
  Synthetic
ucccagcacuuugggaggccgag

SEQ ID NO: 23531 - RNA, 24 nt, Artificial Sequence
  Synthetic
aucccagcacuuugggaggccgag

SEQ ID NO: 23532 - RNA, 18 nt, Artificial Sequence
  Synthetic
cuaauggcagaauucgag

SEQ ID NO: 23533 - RNA, 19 nt, Artificial Sequence
  Synthetic
acuaauggcagaauucgag

SEQ ID NO: 23534 - RNA, 20 nt, Artificial Sequence
  Synthetic
aacuaauggcagaauucgag

SEQ ID NO: 23535 - RNA, 21 nt, Artificial Sequence
  Synthetic
aaacuaauggcagaauucgag

SEQ ID NO: 23536 - RNA, 22 nt, Artificial Sequence
  Synthetic
aaaacuaauggcagaauucgag

SEQ ID NO: 23537 - RNA, 23 nt, Artificial Sequence
  Synthetic
uaaaacuaauggcagaauucgag

SEQ ID NO: 23538 - RNA, 24 nt, Artificial Sequence
  Synthetic
uuaaaacuaauggcagaauucgag

SEQ ID NO: 23539 - RNA, 18 nt, Artificial Sequence
  Synthetic
auggcgugaacccgggag

SEQ ID NO: 23540 - RNA, 19 nt, Artificial Sequence
  Synthetic
aauggcgugaacccgggag

SEQ ID NO: 23541 - RNA, 20 nt, Artificial Sequence
  Synthetic
gaauggcgugaacccgggag

SEQ ID NO: 23542 - RNA, 21 nt, Artificial Sequence
  Synthetic
agaauggcgugaacccgggag

SEQ ID NO: 23543 - RNA, 22 nt, Artificial Sequence
  Synthetic
gagaauggcgugaacccgggag

SEQ ID NO: 23544 - RNA, 23 nt, Artificial Sequence
  Synthetic
ggagaauggcgugaacccgggag

SEQ ID NO: 23545 - RNA, 24 nt, Artificial Sequence
  Synthetic
aggagaauggcgugaacccgggag

SEQ ID NO: 23546 - RNA, 18 nt, Artificial Sequence
  Synthetic
uuagggugggauauggag

SEQ ID NO: 23547 - RNA, 19 nt, Artificial Sequence
  Synthetic
cuuagggugggauauggag

SEQ ID NO: 23548 - RNA, 20 nt, Artificial Sequence
  Synthetic
ucuuagggugggauauggag

SEQ ID NO: 23549 - RNA, 21 nt, Artificial Sequence
  Synthetic
uucuuagggugggauauggag

SEQ ID NO: 23550 - RNA, 22 nt, Artificial Sequence
  Synthetic
guucuuagggugggauauggag

SEQ ID NO: 23551 - RNA, 23 nt, Artificial Sequence
  Synthetic
uguucuuagggugggauauggag

SEQ ID NO: 23552 - RNA, 24 nt, Artificial Sequence
  Synthetic
uuguucuuagggugggauauggag

SEQ ID NO: 23553 - RNA, 18 nt, Artificial Sequence
  Synthetic
cuacugacuaaaacugag

SEQ ID NO: 23554 - RNA, 19 nt, Artificial Sequence
  Synthetic
acuacugacuaaaacugag

SEQ ID NO: 23555 - RNA, 20 nt, Artificial Sequence
  Synthetic
uacuacugacuaaaacugag

SEQ ID NO: 23556 - RNA, 21 nt, Artificial Sequence
  Synthetic
auacuacugacuaaaacugag

SEQ ID NO: 23557 - RNA, 22 nt, Artificial Sequence
  Synthetic
aauacuacugacuaaaacugag

SEQ ID NO: 23558 - RNA, 23 nt, Artificial Sequence
  Synthetic
uaauacuacugacuaaaacugag

SEQ ID NO: 23559 - RNA, 24 nt, Artificial Sequence
  Synthetic
auaauacuacugacuaaaacugag

SEQ ID NO: 23560 - RNA, 18 nt, Artificial Sequence
  Synthetic
ggcggagcuugcagugag

SEQ ID NO: 23561 - RNA, 19 nt, Artificial Sequence
  Synthetic
aggcggagcuugcagugag

SEQ ID NO: 23562 - RNA, 20 nt, Artificial Sequence
  Synthetic
gaggcggagcuugcagugag

SEQ ID NO: 23563 - RNA, 21 nt, Artificial Sequence
  Synthetic
ggaggcggagcuugcagugag

SEQ ID NO: 23564 - RNA, 22 nt, Artificial Sequence
  Synthetic
gggaggcggagcuugcagugag

SEQ ID NO: 23565 - RNA, 23 nt, Artificial Sequence
  Synthetic
cgggaggcggagcuugcagugag

SEQ ID NO: 23566 - RNA, 24 nt, Artificial Sequence
  Synthetic
ccgggaggcggagcuugcagugag

SEQ ID NO: 23567 - RNA, 18 nt, Artificial Sequence
  Synthetic
ggcagagguugcagugag

SEQ ID NO: 23568 - RNA, 19 nt, Artificial Sequence
  Synthetic
aggcagagguugcagugag

SEQ ID NO: 23569 - RNA, 20 nt, Artificial Sequence
  Synthetic
gaggcagagguugcagugag

SEQ ID NO: 23570 - RNA, 21 nt, Artificial Sequence
  Synthetic
ggaggcagagguugcagugag

SEQ ID NO: 23571 - RNA, 22 nt, Artificial Sequence
  Synthetic
gggaggcagagguugcagugag

SEQ ID NO: 23572 - RNA, 23 nt, Artificial Sequence
  Synthetic
cgggaggcagagguugcagugag

SEQ ID NO: 23573 - RNA, 24 nt, Artificial Sequence
  Synthetic
ccgggaggcagagguugcagugag

SEQ ID NO: 23574 - RNA, 18 nt, Artificial Sequence
  Synthetic
gacaccaaauuuauugag

SEQ ID NO: 23575 - RNA, 19 nt, Artificial Sequence
  Synthetic
ugacaccaaauuuauugag

SEQ ID NO: 23576 - RNA, 21 nt, Artificial Sequence
  Synthetic
ccugacaccaaauuuauugag

SEQ ID NO: 23577 - RNA, 22 nt, Artificial Sequence
  Synthetic
gccugacaccaaauuuauugag

SEQ ID NO: 23578 - RNA, 23 nt, Artificial Sequence
  Synthetic
agccugacaccaaauuuauugag

SEQ ID NO: 23579 - RNA, 24 nt, Artificial Sequence
  Synthetic
cagccugacaccaaauuuauugag

SEQ ID NO: 23580 - RNA, 18 nt, Artificial Sequence
  Synthetic
uaauagccuauuguugag

SEQ ID NO: 23581 - RNA, 19 nt, Artificial Sequence
  Synthetic
cuaauagccuauuguugag

SEQ ID NO: 23582 - RNA, 21 nt, Artificial Sequence
  Synthetic
uacuaauagccuauuguugag

SEQ ID NO: 23583 - RNA, 22 nt, Artificial Sequence
  Synthetic
cuacuaauagccuauuguugag

SEQ ID NO: 23584 - RNA, 23 nt, Artificial Sequence
  Synthetic
acuacuaauagccuauuguugag

SEQ ID NO: 23585 - RNA, 24 nt, Artificial Sequence
  Synthetic
aacuacuaauagccuauuguugag

SEQ ID NO: 23586 - RNA, 18 nt, Artificial Sequence
  Synthetic
cuagaugauuauuaauag

SEQ ID NO: 23587 - RNA, 19 nt, Artificial Sequence
  Synthetic
ccuagaugauuauuaauag

SEQ ID NO: 23588 - RNA, 21 nt, Artificial Sequence
  Synthetic
agccuagaugauuauuaauag

SEQ ID NO: 23589 - RNA, 22 nt, Artificial Sequence
  Synthetic
cagccuagaugauuauuaauag

SEQ ID NO: 23590 - RNA, 23 nt, Artificial Sequence
  Synthetic
gcagccuagaugauuauuaauag

SEQ ID NO: 23591 - RNA, 24 nt, Artificial Sequence
  Synthetic
ugcagccuagaugauuauuaauag

SEQ ID NO: 23592 - RNA, 18 nt, Artificial Sequence
  Synthetic
gaaaguuguccaagauag

SEQ ID NO: 23593 - RNA, 19 nt, Artificial Sequence
  Synthetic
ggaaaguuguccaagauag

SEQ ID NO: 23594 - RNA, 21 nt, Artificial Sequence
  Synthetic
auggaaaguuguccaagauag

SEQ ID NO: 23595 - RNA, 22 nt, Artificial Sequence
  Synthetic
uauggaaaguuguccaagauag

SEQ ID NO: 23596 - RNA, 23 nt, Artificial Sequence
  Synthetic
auauggaaaguuguccaagauag

SEQ ID NO: 23597 - RNA, 24 nt, Artificial Sequence
  Synthetic
aauauggaaaguuguccaagauag

SEQ ID NO: 23598 - RNA, 18 nt, Artificial Sequence
  Synthetic
ccucagccucccaaguag

SEQ ID NO: 23599 - RNA, 19 nt, Artificial Sequence
  Synthetic
accucagccucccaaguag

SEQ ID NO: 23600 - RNA, 20 nt, Artificial Sequence
  Synthetic
caccucagccucccaaguag

SEQ ID NO: 23601 - RNA, 21 nt, Artificial Sequence
  Synthetic
ccaccucagccucccaaguag

SEQ ID NO: 23602 - RNA, 22 nt, Artificial Sequence
  Synthetic
cccaccucagccucccaaguag

SEQ ID NO: 23603 - RNA, 23 nt, Artificial Sequence
  Synthetic
ucccaccucagccucccaaguag

SEQ ID NO: 23604 - RNA, 24 nt, Artificial Sequence
  Synthetic
cucccaccucagccucccaaguag

SEQ ID NO: 23605 - RNA, 18 nt, Artificial Sequence
  Synthetic
gguaaguuauagaaguag

SEQ ID NO: 23606 - RNA, 19 nt, Artificial Sequence
  Synthetic
ggguaaguuauagaaguag

SEQ ID NO: 23607 - RNA, 20 nt, Artificial Sequence
  Synthetic
uggguaaguuauagaaguag

SEQ ID NO: 23608 - RNA, 21 nt, Artificial Sequence
  Synthetic
uuggguaaguuauagaaguag

SEQ ID NO: 23609 - RNA, 22 nt, Artificial Sequence
  Synthetic
uuuggguaaguuauagaaguag

SEQ ID NO: 23610 - RNA, 23 nt, Artificial Sequence
  Synthetic
auuuggguaaguuauagaaguag

SEQ ID NO: 23611 - RNA, 24 nt, Artificial Sequence
  Synthetic
uauuuggguaaguuauagaaguag

SEQ ID NO: 23612 - RNA, 18 nt, Artificial Sequence
  Synthetic
ccucagccucccgaguag

SEQ ID NO: 23613 - RNA, 19 nt, Artificial Sequence
  Synthetic
gccucagccucccgaguag

SEQ ID NO: 23614 - RNA, 20 nt, Artificial Sequence
  Synthetic
ugccucagccucccgaguag

SEQ ID NO: 23615 - RNA, 21 nt, Artificial Sequence
  Synthetic
cugccucagccucccgaguag

SEQ ID NO: 23616 - RNA, 22 nt, Artificial Sequence
  Synthetic
ccugccucagccucccgaguag

SEQ ID NO: 23617 - RNA, 23 nt, Artificial Sequence
  Synthetic
uccugccucagccucccgaguag

SEQ ID NO: 23618 - RNA, 24 nt, Artificial Sequence
  Synthetic
cuccugccucagccucccgaguag

SEQ ID NO: 23619 - RNA, 18 nt, Artificial Sequence
  Synthetic
cugacuaaaacugaguag

SEQ ID NO: 23620 - RNA, 19 nt, Artificial Sequence
  Synthetic
acugacuaaaacugaguag

SEQ ID NO: 23621 - RNA, 20 nt, Artificial Sequence
  Synthetic
uacugacuaaaacugaguag

SEQ ID NO: 23622 - RNA, 21 nt, Artificial Sequence
  Synthetic
cuacugacuaaaacugaguag

SEQ ID NO: 23623 - RNA, 22 nt, Artificial Sequence
  Synthetic
acuacugacuaaaacugaguag

SEQ ID NO: 23624 - RNA, 23 nt, Artificial Sequence
  Synthetic
uacuacugacuaaaacugaguag

SEQ ID NO: 23625 - RNA, 24 nt, Artificial Sequence
  Synthetic
auacuacugacuaaaacugaguag

SEQ ID NO: 23626 - RNA, 18 nt, Artificial Sequence
  Synthetic
uagaaggaaaggagguag

SEQ ID NO: 23627 - RNA, 19 nt, Artificial Sequence
  Synthetic
guagaaggaaaggagguag

SEQ ID NO: 23628 - RNA, 20 nt, Artificial Sequence
  Synthetic
aguagaaggaaaggagguag

SEQ ID NO: 23629 - RNA, 21 nt, Artificial Sequence
  Synthetic
gaguagaaggaaaggagguag

SEQ ID NO: 23630 - RNA, 22 nt, Artificial Sequence
  Synthetic
ugaguagaaggaaaggagguag

SEQ ID NO: 23631 - RNA, 23 nt, Artificial Sequence
  Synthetic
cugaguagaaggaaaggagguag

SEQ ID NO: 23632 - RNA, 24 nt, Artificial Sequence
  Synthetic
acugaguagaaggaaaggagguag

SEQ ID NO: 23633 - RNA, 18 nt, Artificial Sequence
  Synthetic
agggagaaauguauguag

SEQ ID NO: 23634 - RNA, 19 nt, Artificial Sequence
  Synthetic
cagggagaaauguauguag

SEQ ID NO: 23635 - RNA, 20 nt, Artificial Sequence
  Synthetic
acagggagaaauguauguag

SEQ ID NO: 23636 - RNA, 21 nt, Artificial Sequence
  Synthetic
aacagggagaaauguauguag

SEQ ID NO: 23637 - RNA, 22 nt, Artificial Sequence
  Synthetic
uaacagggagaaauguauguag

SEQ ID NO: 23638 - RNA, 23 nt, Artificial Sequence
  Synthetic
auaacagggagaaauguauguag

SEQ ID NO: 23639 - RNA, 24 nt, Artificial Sequence
  Synthetic
aauaacagggagaaauguauguag

SEQ ID NO: 23640 - RNA, 18 nt, Artificial Sequence
  Synthetic
aaaaauacaaaaaauuag

SEQ ID NO: 23641 - RNA, 19 nt, Artificial Sequence
  Synthetic
uaaaaauacaaaaaauuag

SEQ ID NO: 23642 - RNA, 20 nt, Artificial Sequence
  Synthetic
cuaaaaauacaaaaaauuag

SEQ ID NO: 23643 - RNA, 21 nt, Artificial Sequence
  Synthetic
acuaaaaauacaaaaaauuag

SEQ ID NO: 23644 - RNA, 22 nt, Artificial Sequence
  Synthetic
uacuaaaaauacaaaaaauuag

SEQ ID NO: 23645 - RNA, 23 nt, Artificial Sequence
  Synthetic
cuacuaaaaauacaaaaaauuag

SEQ ID NO: 23646 - RNA, 24 nt, Artificial Sequence
  Synthetic
ucuacuaaaaauacaaaaaauuag

SEQ ID NO: 23647 - RNA, 18 nt, Artificial Sequence
  Synthetic
aagcuuguuugguuuuag

SEQ ID NO: 23648 - RNA, 19 nt, Artificial Sequence
  Synthetic
aaagcuuguuugguuuuag

SEQ ID NO: 23649 - RNA, 20 nt, Artificial Sequence
  Synthetic
gaaagcuuguuugguuuuag

SEQ ID NO: 23650 - RNA, 21 nt, Artificial Sequence
  Synthetic
ggaaagcuuguuugguuuuag

SEQ ID NO: 23651 - RNA, 22 nt, Artificial Sequence
  Synthetic
uggaaagcuuguuugguuuuag

SEQ ID NO: 23652 - RNA, 23 nt, Artificial Sequence
  Synthetic
auggaaagcuuguuugguuuuag

SEQ ID NO: 23653 - RNA, 24 nt, Artificial Sequence
  Synthetic
cauggaaagcuuguuugguuuuag

SEQ ID NO: 23654 - RNA, 18 nt, Artificial Sequence
  Synthetic
aauuuuuuguauuuuuag

SEQ ID NO: 23655 - RNA, 19 nt, Artificial Sequence
  Synthetic
uaauuuuuuguauuuuuag

SEQ ID NO: 23656 - RNA, 20 nt, Artificial Sequence
  Synthetic
cuaauuuuuuguauuuuuag

SEQ ID NO: 23657 - RNA, 21 nt, Artificial Sequence
  Synthetic
gcuaauuuuuuguauuuuuag

SEQ ID NO: 23658 - RNA, 22 nt, Artificial Sequence
  Synthetic
ggcuaauuuuuuguauuuuuag

SEQ ID NO: 23659 - RNA, 23 nt, Artificial Sequence
  Synthetic
uggcuaauuuuuuguauuuuuag

SEQ ID NO: 23660 - RNA, 24 nt, Artificial Sequence
  Synthetic
cuggcuaauuuuuuguauuuuuag

SEQ ID NO: 23661 - RNA, 18 nt, Artificial Sequence
  Synthetic
accaucccggcuaaaacg

SEQ ID NO: 23662 - RNA, 19 nt, Artificial Sequence
  Synthetic
gaccaucccggcuaaaacg

SEQ ID NO: 23663 - RNA, 20 nt, Artificial Sequence
  Synthetic
agaccaucccggcuaaaacg

SEQ ID NO: 23664 - RNA, 21 nt, Artificial Sequence
  Synthetic
gagaccaucccggcuaaaacg

SEQ ID NO: 23665 - RNA, 22 nt, Artificial Sequence
  Synthetic
cgagaccaucccggcuaaaacg

SEQ ID NO: 23666 - RNA, 23 nt, Artificial Sequence
  Synthetic
ucgagaccaucccggcuaaaacg

SEQ ID NO: 23667 - RNA, 24 nt, Artificial Sequence
  Synthetic
aucgagaccaucccggcuaaaacg

SEQ ID NO: 23668 - RNA, 18 nt, Artificial Sequence
  Synthetic
aaaaacaacaaaaaagcg

SEQ ID NO: 23669 - RNA, 19 nt, Artificial Sequence
  Synthetic
gaaaaacaacaaaaaagcg

SEQ ID NO: 23670 - RNA, 20 nt, Artificial Sequence
  Synthetic
agaaaaacaacaaaaaagcg

SEQ ID NO: 23671 - RNA, 21 nt, Artificial Sequence
  Synthetic
uagaaaaacaacaaaaaagcg

SEQ ID NO: 23672 - RNA, 22 nt, Artificial Sequence
  Synthetic
cuagaaaaacaacaaaaaagcg

SEQ ID NO: 23673 - RNA, 23 nt, Artificial Sequence
  Synthetic
acuagaaaaacaacaaaaaagcg

SEQ ID NO: 23674 - RNA, 24 nt, Artificial Sequence
  Synthetic
aacuagaaaaacaacaaaaaagcg

SEQ ID NO: 23675 - RNA, 18 nt, Artificial Sequence
  Synthetic
gcaaagagugcauaaagg

SEQ ID NO: 23676 - RNA, 19 nt, Artificial Sequence
  Synthetic
agcaaagagugcauaaagg

SEQ ID NO: 23677 - RNA, 20 nt, Artificial Sequence
  Synthetic
aagcaaagagugcauaaagg

SEQ ID NO: 23678 - RNA, 21 nt, Artificial Sequence
  Synthetic
aaagcaaagagugcauaaagg

SEQ ID NO: 23679 - RNA, 22 nt, Artificial Sequence
  Synthetic
uaaagcaaagagugcauaaagg

SEQ ID NO: 23680 - RNA, 23 nt, Artificial Sequence
  Synthetic
cuaaagcaaagagugcauaaagg

SEQ ID NO: 23681 - RNA, 24 nt, Artificial Sequence
  Synthetic
ccuaaagcaaagagugcauaaagg

SEQ ID NO: 23682 - RNA, 18 nt, Artificial Sequence
  Synthetic
uauaagaaaugaaacagg

SEQ ID NO: 23683 - RNA, 19 nt, Artificial Sequence
  Synthetic
auauaagaaaugaaacagg

SEQ ID NO: 23684 - RNA, 20 nt, Artificial Sequence
  Synthetic
gauauaagaaaugaaacagg

SEQ ID NO: 23685 - RNA, 21 nt, Artificial Sequence
  Synthetic
cgauauaagaaaugaaacagg

SEQ ID NO: 23686 - RNA, 22 nt, Artificial Sequence
  Synthetic
acgauauaagaaaugaaacagg

SEQ ID NO: 23687 - RNA, 23 nt, Artificial Sequence
  Synthetic
uacgauauaagaaaugaaacagg

SEQ ID NO: 23688 - RNA, 24 nt, Artificial Sequence
  Synthetic
auacgauauaagaaaugaaacagg

SEQ ID NO: 23689 - RNA, 18 nt, Artificial Sequence
  Synthetic
ccuauaaggaauaacagg

SEQ ID NO: 23690 - RNA, 19 nt, Artificial Sequence
  Synthetic
accuauaaggaauaacagg

SEQ ID NO: 23691 - RNA, 20 nt, Artificial Sequence
  Synthetic
aaccuauaaggaauaacagg

SEQ ID NO: 23692 - RNA, 21 nt, Artificial Sequence
  Synthetic
gaaccuauaaggaauaacagg

SEQ ID NO: 23693 - RNA, 22 nt, Artificial Sequence
  Synthetic
agaaccuauaaggaauaacagg

SEQ ID NO: 23694 - RNA, 23 nt, Artificial Sequence
  Synthetic
cagaaccuauaaggaauaacagg

SEQ ID NO: 23695 - RNA, 24 nt, Artificial Sequence
  Synthetic
acagaaccuauaaggaauaacagg

SEQ ID NO: 23696 - RNA, 18 nt, Artificial Sequence
  Synthetic
aguagaaaccuaaucagg

SEQ ID NO: 23697 - RNA, 19 nt, Artificial Sequence
  Synthetic
uaguagaaaccuaaucagg

SEQ ID NO: 23698 - RNA, 20 nt, Artificial Sequence
  Synthetic
uuaguagaaaccuaaucagg

SEQ ID NO: 23699 - RNA, 21 nt, Artificial Sequence
  Synthetic
uuuaguagaaaccuaaucagg

SEQ ID NO: 23700 - RNA, 22 nt, Artificial Sequence
  Synthetic
uuuuaguagaaaccuaaucagg

SEQ ID NO: 23701 - RNA, 23 nt, Artificial Sequence
  Synthetic
guuuuaguagaaaccuaaucagg

SEQ ID NO: 23702 - RNA, 24 nt, Artificial Sequence
  Synthetic
gguuuuaguagaaaccuaaucagg

SEQ ID NO: 23703 - RNA, 18 nt, Artificial Sequence
  Synthetic
gaaaggagguagcagagg

SEQ ID NO: 23704 - RNA, 19 nt, Artificial Sequence
  Synthetic
ggaaaggagguagcagagg

SEQ ID NO: 23705 - RNA, 20 nt, Artificial Sequence
  Synthetic
aggaaaggagguagcagagg

SEQ ID NO: 23706 - RNA, 21 nt, Artificial Sequence
  Synthetic
aaggaaaggagguagcagagg

SEQ ID NO: 23707 - RNA, 22 nt, Artificial Sequence
  Synthetic
gaaggaaaggagguagcagagg

SEQ ID NO: 23708 - RNA, 23 nt, Artificial Sequence
  Synthetic
agaaggaaaggagguagcagagg

SEQ ID NO: 23709 - RNA, 24 nt, Artificial Sequence
  Synthetic
uagaaggaaaggagguagcagagg

SEQ ID NO: 23710 - RNA, 18 nt, Artificial Sequence
  Synthetic
guuacauaaaaagagagg

SEQ ID NO: 23711 - RNA, 19 nt, Artificial Sequence
  Synthetic
uguuacauaaaaagagagg

SEQ ID NO: 23712 - RNA, 21 nt, Artificial Sequence
  Synthetic
auuguuacauaaaaagagagg

SEQ ID NO: 23713 - RNA, 22 nt, Artificial Sequence
  Synthetic
uauuguuacauaaaaagagagg

SEQ ID NO: 23714 - RNA, 23 nt, Artificial Sequence
  Synthetic
auauuguuacauaaaaagagagg

SEQ ID NO: 23715 - RNA, 24 nt, Artificial Sequence
  Synthetic
cauauuguuacauaaaaagagagg

SEQ ID NO: 23716 - RNA, 18 nt, Artificial Sequence
  Synthetic
uggcgugaacccgggagg

SEQ ID NO: 23717 - RNA, 19 nt, Artificial Sequence
  Synthetic
auggcgugaacccgggagg

SEQ ID NO: 23718 - RNA, 21 nt, Artificial Sequence
  Synthetic
gaauggcgugaacccgggagg

SEQ ID NO: 23719 - RNA, 22 nt, Artificial Sequence
  Synthetic
agaauggcgugaacccgggagg

SEQ ID NO: 23720 - RNA, 23 nt, Artificial Sequence
  Synthetic
gagaauggcgugaacccgggagg

SEQ ID NO: 23721 - RNA, 24 nt, Artificial Sequence
  Synthetic
ggagaauggcgugaacccgggagg

SEQ ID NO: 23722 - RNA, 18 nt, Artificial Sequence
  Synthetic
uugcuugagcccgggagg

SEQ ID NO: 23723 - RNA, 19 nt, Artificial Sequence
  Synthetic
auugcuugagcccgggagg

SEQ ID NO: 23724 - RNA, 20 nt, Artificial Sequence
  Synthetic
aauugcuugagcccgggagg

SEQ ID NO: 23725 - RNA, 21 nt, Artificial Sequence
  Synthetic
gaauugcuugagcccgggagg

SEQ ID NO: 23726 - RNA, 22 nt, Artificial Sequence
  Synthetic
agaauugcuugagcccgggagg

SEQ ID NO: 23727 - RNA, 23 nt, Artificial Sequence
  Synthetic
gagaauugcuugagcccgggagg

SEQ ID NO: 23728 - RNA, 24 nt, Artificial Sequence
  Synthetic
ggagaauugcuugagcccgggagg

SEQ ID NO: 23729 - RNA, 18 nt, Artificial Sequence
  Synthetic
ucccagcuacuugggagg

SEQ ID NO: 23730 - RNA, 19 nt, Artificial Sequence
  Synthetic
gucccagcuacuugggagg

SEQ ID NO: 23731 - RNA, 20 nt, Artificial Sequence
  Synthetic
agucccagcuacuugggagg

SEQ ID NO: 23732 - RNA, 21 nt, Artificial Sequence
  Synthetic
uagucccagcuacuugggagg

SEQ ID NO: 23733 - RNA, 22 nt, Artificial Sequence
  Synthetic
guagucccagcuacuugggagg

SEQ ID NO: 23734 - RNA, 23 nt, Artificial Sequence
  Synthetic
uguagucccagcuacuugggagg

SEQ ID NO: 23735 - RNA, 24 nt, Artificial Sequence
  Synthetic
cuguagucccagcuacuugggagg

SEQ ID NO: 23736 - RNA, 18 nt, Artificial Sequence
  Synthetic
ucccaacacuuugggagg

SEQ ID NO: 23737 - RNA, 19 nt, Artificial Sequence
  Synthetic
aucccaacacuuugggagg

SEQ ID NO: 23738 - RNA, 20 nt, Artificial Sequence
  Synthetic
aaucccaacacuuugggagg

SEQ ID NO: 23739 - RNA, 21 nt, Artificial Sequence
  Synthetic
uaaucccaacacuuugggagg

SEQ ID NO: 23740 - RNA, 22 nt, Artificial Sequence
  Synthetic
guaaucccaacacuuugggagg

SEQ ID NO: 23741 - RNA, 23 nt, Artificial Sequence
  Synthetic
uguaaucccaacacuuugggagg

SEQ ID NO: 23742 - RNA, 24 nt, Artificial Sequence
  Synthetic
cuguaaucccaacacuuugggagg

SEQ ID NO: 23743 - RNA, 18 nt, Artificial Sequence
  Synthetic
acccagcacuuugggagg

SEQ ID NO: 23744 - RNA, 19 nt, Artificial Sequence
  Synthetic
aacccagcacuuugggagg

SEQ ID NO: 23745 - RNA, 20 nt, Artificial Sequence
  Synthetic
aaacccagcacuuugggagg

SEQ ID NO: 23746 - RNA, 21 nt, Artificial Sequence
  Synthetic
uaaacccagcacuuugggagg

SEQ ID NO: 23747 - RNA, 22 nt, Artificial Sequence
  Synthetic
auaaacccagcacuuugggagg

SEQ ID NO: 23748 - RNA, 23 nt, Artificial Sequence
  Synthetic
uauaaacccagcacuuugggagg

SEQ ID NO: 23749 - RNA, 24 nt, Artificial Sequence
  Synthetic
cuauaaacccagcacuuugggagg

SEQ ID NO: 23750 - RNA, 18 nt, Artificial Sequence
  Synthetic
ucccagcacuuugggagg

SEQ ID NO: 23751 - RNA, 19 nt, Artificial Sequence
  Synthetic
aucccagcacuuugggagg

SEQ ID NO: 23752 - RNA, 20 nt, Artificial Sequence
  Synthetic
aaucccagcacuuugggagg

SEQ ID NO: 23753 - RNA, 21 nt, Artificial Sequence
  Synthetic
uaaucccagcacuuugggagg

SEQ ID NO: 23754 - RNA, 22 nt, Artificial Sequence
  Synthetic
guaaucccagcacuuugggagg

SEQ ID NO: 23755 - RNA, 23 nt, Artificial Sequence
  Synthetic
uguaaucccagcacuuugggagg

SEQ ID NO: 23756 - RNA, 24 nt, Artificial Sequence
  Synthetic
cuguaaucccagcacuuugggagg

SEQ ID NO: 23757 - RNA, 18 nt, Artificial Sequence
  Synthetic
uucucacaguucuggagg

SEQ ID NO: 23758 - RNA, 19 nt, Artificial Sequence
  Synthetic
uuucucacaguucuggagg

SEQ ID NO: 23759 - RNA, 20 nt, Artificial Sequence
  Synthetic
auuucucacaguucuggagg

SEQ ID NO: 23760 - RNA, 21 nt, Artificial Sequence
  Synthetic
uauuucucacaguucuggagg

SEQ ID NO: 23761 - RNA, 22 nt, Artificial Sequence
  Synthetic
uuauuucucacaguucuggagg

SEQ ID NO: 23762 - RNA, 23 nt, Artificial Sequence
  Synthetic
uuuauuucucacaguucuggagg

SEQ ID NO: 23763 - RNA, 24 nt, Artificial Sequence
  Synthetic
auuuauuucucacaguucuggagg

SEQ ID NO: 23764 - RNA, 21 nt, Artificial Sequence
  Synthetic
cagcuacuugggaggcugagg

SEQ ID NO: 23765 - RNA, 22 nt, Artificial Sequence
  Synthetic
ccagcuacuugggaggcugagg

SEQ ID NO: 23766 - RNA, 23 nt, Artificial Sequence
  Synthetic
cccagcuacuugggaggcugagg

SEQ ID NO: 23767 - RNA, 24 nt, Artificial Sequence
  Synthetic
ucccagcuacuugggaggcugagg

SEQ ID NO: 23768 - RNA, 18 nt, Artificial Sequence
  Synthetic
cuacuugggagggugagg

SEQ ID NO: 23769 - RNA, 19 nt, Artificial Sequence
  Synthetic
gcuacuugggagggugagg

SEQ ID NO: 23770 - RNA, 20 nt, Artificial Sequence
  Synthetic
agcuacuugggagggugagg

SEQ ID NO: 23771 - RNA, 21 nt, Artificial Sequence
  Synthetic
cagcuacuugggagggugagg

SEQ ID NO: 23772 - RNA, 22 nt, Artificial Sequence
  Synthetic
ccagcuacuugggagggugagg

SEQ ID NO: 23773 - RNA, 23 nt, Artificial Sequence
  Synthetic
cccagcuacuugggagggugagg

SEQ ID NO: 23774 - RNA, 24 nt, Artificial Sequence
  Synthetic
ucccagcuacuugggagggugagg

SEQ ID NO: 23775 - RNA, 18 nt, Artificial Sequence
  Synthetic
gguuaaguuguucuuagg

SEQ ID NO: 23776 - RNA, 19 nt, Artificial Sequence
  Synthetic
agguuaaguuguucuuagg

SEQ ID NO: 23777 - RNA, 20 nt, Artificial Sequence
  Synthetic
cagguuaaguuguucuuagg

SEQ ID NO: 23778 - RNA, 21 nt, Artificial Sequence
  Synthetic
ccagguuaaguuguucuuagg

SEQ ID NO: 23779 - RNA, 22 nt, Artificial Sequence
  Synthetic
gccagguuaaguuguucuuagg

SEQ ID NO: 23780 - RNA, 23 nt, Artificial Sequence
  Synthetic
ugccagguuaaguuguucuuagg

SEQ ID NO: 23781 - RNA, 24 nt, Artificial Sequence
  Synthetic
augccagguuaaguuguucuuagg

SEQ ID NO: 23782 - RNA, 18 nt, Artificial Sequence
  Synthetic
cucacauggcagaaaggg

SEQ ID NO: 23783 - RNA, 19 nt, Artificial Sequence
  Synthetic
ucucacauggcagaaaggg

SEQ ID NO: 23784 - RNA, 20 nt, Artificial Sequence
  Synthetic
uucucacauggcagaaaggg

SEQ ID NO: 23785 - RNA, 21 nt, Artificial Sequence
  Synthetic
guucucacauggcagaaaggg

SEQ ID NO: 23786 - RNA, 22 nt, Artificial Sequence
  Synthetic
uguucucacauggcagaaaggg

SEQ ID NO: 23787 - RNA, 23 nt, Artificial Sequence
  Synthetic
guguucucacauggcagaaaggg

SEQ ID NO: 23788 - RNA, 24 nt, Artificial Sequence
  Synthetic
uguguucucacauggcagaaaggg

SEQ ID NO: 23789 - RNA, 18 nt, Artificial Sequence
  Synthetic
aacauaugaauggcaggg

SEQ ID NO: 23790 - RNA, 19 nt, Artificial Sequence
  Synthetic
caacauaugaauggcaggg

SEQ ID NO: 23791 - RNA, 20 nt, Artificial Sequence
  Synthetic
ucaacauaugaauggcaggg

SEQ ID NO: 23792 - RNA, 21 nt, Artificial Sequence
  Synthetic
uucaacauaugaauggcaggg

SEQ ID NO: 23793 - RNA, 22 nt, Artificial Sequence
  Synthetic
uuucaacauaugaauggcaggg

SEQ ID NO: 23794 - RNA, 23 nt, Artificial Sequence
  Synthetic
auuucaacauaugaauggcaggg

SEQ ID NO: 23795 - RNA, 24 nt, Artificial Sequence
  Synthetic
gauuucaacauaugaauggcaggg

SEQ ID NO: 23796 - RNA, 18 nt, Artificial Sequence
  Synthetic
uugguacaaauuucaggg

SEQ ID NO: 23797 - RNA, 19 nt, Artificial Sequence
  Synthetic
auugguacaaauuucaggg

SEQ ID NO: 23798 - RNA, 20 nt, Artificial Sequence
  Synthetic
aauugguacaaauuucaggg

SEQ ID NO: 23799 - RNA, 21 nt, Artificial Sequence
  Synthetic
gaauugguacaaauuucaggg

SEQ ID NO: 23800 - RNA, 22 nt, Artificial Sequence
  Synthetic
cgaauugguacaaauuucaggg

SEQ ID NO: 23801 - RNA, 23 nt, Artificial Sequence
  Synthetic
acgaauugguacaaauuucaggg

SEQ ID NO: 23802 - RNA, 24 nt, Artificial Sequence
  Synthetic
uacgaauugguacaaauuucaggg

SEQ ID NO: 23803 - RNA, 18 nt, Artificial Sequence
  Synthetic
auuucaacauaugaaugg

SEQ ID NO: 23804 - RNA, 19 nt, Artificial Sequence
  Synthetic
gauuucaacauaugaaugg

SEQ ID NO: 23805 - RNA, 20 nt, Artificial Sequence
  Synthetic
ggauuucaacauaugaaugg

SEQ ID NO: 23806 - RNA, 21 nt, Artificial Sequence
  Synthetic
aggauuucaacauaugaaugg

SEQ ID NO: 23807 - RNA, 22 nt, Artificial Sequence
  Synthetic
uaggauuucaacauaugaaugg

SEQ ID NO: 23808 - RNA, 23 nt, Artificial Sequence
  Synthetic
uuaggauuucaacauaugaaugg

SEQ ID NO: 23809 - RNA, 24 nt, Artificial Sequence
  Synthetic
auuaggauuucaacauaugaaugg

SEQ ID NO: 23810 - RNA, 18 nt, Artificial Sequence
  Synthetic
ugcuguguucucacaugg

SEQ ID NO: 23811 - RNA, 19 nt, Artificial Sequence
  Synthetic
cugcuguguucucacaugg

SEQ ID NO: 23812 - RNA, 20 nt, Artificial Sequence
  Synthetic
ccugcuguguucucacaugg

SEQ ID NO: 23813 - RNA, 21 nt, Artificial Sequence
  Synthetic
uccugcuguguucucacaugg

SEQ ID NO: 23814 - RNA, 22 nt, Artificial Sequence
  Synthetic
uuccugcuguguucucacaugg

SEQ ID NO: 23815 - RNA, 23 nt, Artificial Sequence
  Synthetic
cuuccugcuguguucucacaugg

SEQ ID NO: 23816 - RNA, 24 nt, Artificial Sequence
  Synthetic
ucuuccugcuguguucucacaugg

SEQ ID NO: 23817 - RNA, 18 nt, Artificial Sequence
  Synthetic
auuggcuaccuugguugg

SEQ ID NO: 23818 - RNA, 19 nt, Artificial Sequence
  Synthetic
gauuggcuaccuugguugg

SEQ ID NO: 23819 - RNA, 20 nt, Artificial Sequence
  Synthetic
ggauuggcuaccuugguugg

SEQ ID NO: 23820 - RNA, 21 nt, Artificial Sequence
  Synthetic
uggauuggcuaccuugguugg

SEQ ID NO: 23821 - RNA, 22 nt, Artificial Sequence
  Synthetic
cuggauuggcuaccuugguugg

SEQ ID NO: 23822 - RNA, 23 nt, Artificial Sequence
  Synthetic
ccuggauuggcuaccuugguugg

SEQ ID NO: 23823 - RNA, 24 nt, Artificial Sequence
  Synthetic
accuggauuggcuaccuugguugg

SEQ ID NO: 23824 - RNA, 18 nt, Artificial Sequence
  Synthetic
ugguuggaugagggaaug

SEQ ID NO: 23825 - RNA, 19 nt, Artificial Sequence
  Synthetic
uugguuggaugagggaaug

SEQ ID NO: 23826 - RNA, 20 nt, Artificial Sequence
  Synthetic
cuugguuggaugagggaaug

SEQ ID NO: 23827 - RNA, 21 nt, Artificial Sequence
  Synthetic
ccuugguuggaugagggaaug

SEQ ID NO: 23828 - RNA, 22 nt, Artificial Sequence
  Synthetic
accuugguuggaugagggaaug

SEQ ID NO: 23829 - RNA, 23 nt, Artificial Sequence
  Synthetic
uaccuugguuggaugagggaaug

SEQ ID NO: 23830 - RNA, 24 nt, Artificial Sequence
  Synthetic
cuaccuugguuggaugagggaaug

SEQ ID NO: 23831 - RNA, 18 nt, Artificial Sequence
  Synthetic
gaaagcaguguuauaaug

SEQ ID NO: 23832 - RNA, 19 nt, Artificial Sequence
  Synthetic
ugaaagcaguguuauaaug

SEQ ID NO: 23833 - RNA, 20 nt, Artificial Sequence
  Synthetic
cugaaagcaguguuauaaug

SEQ ID NO: 23834 - RNA, 21 nt, Artificial Sequence
  Synthetic
ccugaaagcaguguuauaaug

SEQ ID NO: 23835 - RNA, 22 nt, Artificial Sequence
  Synthetic
uccugaaagcaguguuauaaug

SEQ ID NO: 23836 - RNA, 23 nt, Artificial Sequence
  Synthetic
cuccugaaagcaguguuauaaug

SEQ ID NO: 23837 - RNA, 24 nt, Artificial Sequence
  Synthetic
gcuccugaaagcaguguuauaaug

SEQ ID NO: 23838 - RNA, 18 nt, Artificial Sequence
  Synthetic
ggcauugcacuaaacaug

SEQ ID NO: 23839 - RNA, 19 nt, Artificial Sequence
  Synthetic
uggcauugcacuaaacaug

SEQ ID NO: 23840 - RNA, 20 nt, Artificial Sequence
  Synthetic
auggcauugcacuaaacaug

SEQ ID NO: 23841 - RNA, 21 nt, Artificial Sequence
  Synthetic
uauggcauugcacuaaacaug

SEQ ID NO: 23842 - RNA, 22 nt, Artificial Sequence
  Synthetic
uuauggcauugcacuaaacaug

SEQ ID NO: 23843 - RNA, 23 nt, Artificial Sequence
  Synthetic
uuuauggcauugcacuaaacaug

SEQ ID NO: 23844 - RNA, 24 nt, Artificial Sequence
  Synthetic
guuuauggcauugcacuaaacaug

SEQ ID NO: 23845 - RNA, 18 nt, Artificial Sequence
  Synthetic
accauccuggccaacaug

SEQ ID NO: 23846 - RNA, 19 nt, Artificial Sequence
  Synthetic
uaccauccuggccaacaug

SEQ ID NO: 23847 - RNA, 20 nt, Artificial Sequence
  Synthetic
auaccauccuggccaacaug

SEQ ID NO: 23848 - RNA, 21 nt, Artificial Sequence
  Synthetic
aauaccauccuggccaacaug

SEQ ID NO: 23849 - RNA, 22 nt, Artificial Sequence
  Synthetic
caauaccauccuggccaacaug

SEQ ID NO: 23850 - RNA, 23 nt, Artificial Sequence
  Synthetic
ucaauaccauccuggccaacaug

SEQ ID NO: 23851 - RNA, 24 nt, Artificial Sequence
  Synthetic
aucaauaccauccuggccaacaug

SEQ ID NO: 23852 - RNA, 18 nt, Artificial Sequence
  Synthetic
aaaagauaagugaagaug

SEQ ID NO: 23853 - RNA, 19 nt, Artificial Sequence
  Synthetic
aaaaagauaagugaagaug

SEQ ID NO: 23854 - RNA, 20 nt, Artificial Sequence
  Synthetic
aaaaaagauaagugaagaug

SEQ ID NO: 23855 - RNA, 21 nt, Artificial Sequence
  Synthetic
gaaaaaagauaagugaagaug

SEQ ID NO: 23856 - RNA, 22 nt, Artificial Sequence
  Synthetic
agaaaaaagauaagugaagaug

SEQ ID NO: 23857 - RNA, 23 nt, Artificial Sequence
  Synthetic
uagaaaaaagauaagugaagaug

SEQ ID NO: 23858 - RNA, 24 nt, Artificial Sequence
  Synthetic
guagaaaaaagauaagugaagaug

SEQ ID NO: 23859 - RNA, 18 nt, Artificial Sequence
  Synthetic
ggcuaccuugguuggaug

SEQ ID NO: 23860 - RNA, 19 nt, Artificial Sequence
  Synthetic
uggcuaccuugguuggaug

SEQ ID NO: 23861 - RNA, 21 nt, Artificial Sequence
  Synthetic
auuggcuaccuugguuggaug

SEQ ID NO: 23862 - RNA, 22 nt, Artificial Sequence
  Synthetic
gauuggcuaccuugguuggaug

SEQ ID NO: 23863 - RNA, 23 nt, Artificial Sequence
  Synthetic
ggauuggcuaccuugguuggaug

SEQ ID NO: 23864 - RNA, 24 nt, Artificial Sequence
  Synthetic
uggauuggcuaccuugguuggaug

SEQ ID NO: 23865 - RNA, 18 nt, Artificial Sequence
  Synthetic
uucuuagggugggauaug

SEQ ID NO: 23866 - RNA, 19 nt, Artificial Sequence
  Synthetic
guucuuagggugggauaug

SEQ ID NO: 23867 - RNA, 20 nt, Artificial Sequence
  Synthetic
uguucuuagggugggauaug

SEQ ID NO: 23868 - RNA, 21 nt, Artificial Sequence
  Synthetic
uuguucuuagggugggauaug

SEQ ID NO: 23869 - RNA, 22 nt, Artificial Sequence
  Synthetic
guuguucuuagggugggauaug

SEQ ID NO: 23870 - RNA, 23 nt, Artificial Sequence
  Synthetic
aguuguucuuagggugggauaug

SEQ ID NO: 23871 - RNA, 24 nt, Artificial Sequence
  Synthetic
aaguuguucuuagggugggauaug

SEQ ID NO: 23872 - RNA, 18 nt, Artificial Sequence
  Synthetic
uaaaagcuguuucguaug

SEQ ID NO: 23873 - RNA, 19 nt, Artificial Sequence
  Synthetic
uuaaaagcuguuucguaug

SEQ ID NO: 23874 - RNA, 20 nt, Artificial Sequence
  Synthetic
uuuaaaagcuguuucguaug

SEQ ID NO: 23875 - RNA, 21 nt, Artificial Sequence
  Synthetic
uuuuaaaagcuguuucguaug

SEQ ID NO: 23876 - RNA, 22 nt, Artificial Sequence
  Synthetic
guuuuaaaagcuguuucguaug

SEQ ID NO: 23877 - RNA, 23 nt, Artificial Sequence
  Synthetic
uguuuuaaaagcuguuucguaug

SEQ ID NO: 23878 - RNA, 24 nt, Artificial Sequence
  Synthetic
uuguuuuaaaagcuguuucguaug

SEQ ID NO: 23879 - RNA, 18 nt, Artificial Sequence
  Synthetic
uauguaggaaaacaacug

SEQ ID NO: 23880 - RNA, 19 nt, Artificial Sequence
  Synthetic
guauguaggaaaacaacug

SEQ ID NO: 23881 - RNA, 20 nt, Artificial Sequence
  Synthetic
cguauguaggaaaacaacug

SEQ ID NO: 23882 - RNA, 21 nt, Artificial Sequence
  Synthetic
ucguauguaggaaaacaacug

SEQ ID NO: 23883 - RNA, 22 nt, Artificial Sequence
  Synthetic
uucguauguaggaaaacaacug

SEQ ID NO: 23884 - RNA, 23 nt, Artificial Sequence
  Synthetic
uuucguauguaggaaaacaacug

SEQ ID NO: 23885 - RNA, 24 nt, Artificial Sequence
  Synthetic
guuucguauguaggaaaacaacug

SEQ ID NO: 23886 - RNA, 18 nt, Artificial Sequence
  Synthetic
gaaacuccccacacacug

SEQ ID NO: 23887 - RNA, 19 nt, Artificial Sequence
  Synthetic
ugaaacuccccacacacug

SEQ ID NO: 23888 - RNA, 20 nt, Artificial Sequence
  Synthetic
cugaaacuccccacacacug

SEQ ID NO: 23889 - RNA, 21 nt, Artificial Sequence
  Synthetic
acugaaacuccccacacacug

SEQ ID NO: 23890 - RNA, 22 nt, Artificial Sequence
  Synthetic
gacugaaacuccccacacacug

SEQ ID NO: 23891 - RNA, 23 nt, Artificial Sequence
  Synthetic
ggacugaaacuccccacacacug

SEQ ID NO: 23892 - RNA, 24 nt, Artificial Sequence
  Synthetic
aggacugaaacuccccacacacug

SEQ ID NO: 23893 - RNA, 18 nt, Artificial Sequence
  Synthetic
gcaauaugcaauuuacug

SEQ ID NO: 23894 - RNA, 19 nt, Artificial Sequence
  Synthetic
ugcaauaugcaauuuacug

SEQ ID NO: 23895 - RNA, 20 nt, Artificial Sequence
  Synthetic
cugcaauaugcaauuuacug

SEQ ID NO: 23896 - RNA, 21 nt, Artificial Sequence
  Synthetic
acugcaauaugcaauuuacug

SEQ ID NO: 23897 - RNA, 22 nt, Artificial Sequence
  Synthetic
uacugcaauaugcaauuuacug

SEQ ID NO: 23898 - RNA, 23 nt, Artificial Sequence
  Synthetic
uuacugcaauaugcaauuuacug

SEQ ID NO: 23899 - RNA, 24 nt, Artificial Sequence
  Synthetic
uuuacugcaauaugcaauuuacug

SEQ ID NO: 23900 - RNA, 18 nt, Artificial Sequence
  Synthetic
caucuguuaguaaugcug

SEQ ID NO: 23901 - RNA, 19 nt, Artificial Sequence
  Synthetic
ucaucuguuaguaaugcug

SEQ ID NO: 23902 - RNA, 21 nt, Artificial Sequence
  Synthetic
uaucaucuguuaguaaugcug

SEQ ID NO: 23903 - RNA, 22 nt, Artificial Sequence
  Synthetic
auaucaucuguuaguaaugcug

SEQ ID NO: 23904 - RNA, 23 nt, Artificial Sequence
  Synthetic
aauaucaucuguuaguaaugcug

SEQ ID NO: 23905 - RNA, 24 nt, Artificial Sequence
  Synthetic
uaauaucaucuguuaguaaugcug

SEQ ID NO: 23906 - RNA, 18 nt, Artificial Sequence
  Synthetic
aauuagccgggcguagug

SEQ ID NO: 23907 - RNA, 19 nt, Artificial Sequence
  Synthetic
aaauuagccgggcguagug

SEQ ID NO: 23908 - RNA, 20 nt, Artificial Sequence
  Synthetic
aaaauuagccgggcguagug

SEQ ID NO: 23909 - RNA, 21 nt, Artificial Sequence
  Synthetic
aaaaauuagccgggcguagug

SEQ ID NO: 23910 - RNA, 22 nt, Artificial Sequence
  Synthetic
aaaaaauuagccgggcguagug

SEQ ID NO: 23911 - RNA, 23 nt, Artificial Sequence
  Synthetic
caaaaaauuagccgggcguagug

SEQ ID NO: 23912 - RNA, 24 nt, Artificial Sequence
  Synthetic
acaaaaaauuagccgggcguagug

SEQ ID NO: 23913 - RNA, 18 nt, Artificial Sequence
  Synthetic
ucuguuaguaaugcugug

SEQ ID NO: 23914 - RNA, 19 nt, Artificial Sequence
  Synthetic
aucuguuaguaaugcugug

SEQ ID NO: 23915 - RNA, 21 nt, Artificial Sequence
  Synthetic
ucaucuguuaguaaugcugug

SEQ ID NO: 23916 - RNA, 22 nt, Artificial Sequence
  Synthetic
aucaucuguuaguaaugcugug

SEQ ID NO: 23917 - RNA, 23 nt, Artificial Sequence
  Synthetic
uaucaucuguuaguaaugcugug

SEQ ID NO: 23918 - RNA, 24 nt, Artificial Sequence
  Synthetic
auaucaucuguuaguaaugcugug

SEQ ID NO: 23919 - RNA, 18 nt, Artificial Sequence
  Synthetic
auucaaaaaauauuugug

SEQ ID NO: 23920 - RNA, 19 nt, Artificial Sequence
  Synthetic
uauucaaaaaauauuugug

SEQ ID NO: 23921 - RNA, 20 nt, Artificial Sequence
  Synthetic
cuauucaaaaaauauuugug

SEQ ID NO: 23922 - RNA, 21 nt, Artificial Sequence
  Synthetic
ucuauucaaaaaauauuugug

SEQ ID NO: 23923 - RNA, 22 nt, Artificial Sequence
  Synthetic
aucuauucaaaaaauauuugug

SEQ ID NO: 23924 - RNA, 23 nt, Artificial Sequence
  Synthetic
aaucuauucaaaaaauauuugug

SEQ ID NO: 23925 - RNA, 24 nt, Artificial Sequence
  Synthetic
uaaucuauucaaaaaauauuugug

SEQ ID NO: 23926 - RNA, 18 nt, Artificial Sequence
  Synthetic
cuauucaaaaaauauuug

SEQ ID NO: 23927 - RNA, 19 nt, Artificial Sequence
  Synthetic
ucuauucaaaaaauauuug

SEQ ID NO: 23928 - RNA, 21 nt, Artificial Sequence
  Synthetic
aaucuauucaaaaaauauuug

SEQ ID NO: 23929 - RNA, 22 nt, Artificial Sequence
  Synthetic
uaaucuauucaaaaaauauuug

SEQ ID NO: 23930 - RNA, 23 nt, Artificial Sequence
  Synthetic
cuaaucuauucaaaaaauauuug

SEQ ID NO: 23931 - RNA, 24 nt, Artificial Sequence
  Synthetic
gcuaaucuauucaaaaaauauuug

SEQ ID NO: 23932 - RNA, 18 nt, Artificial Sequence
  Synthetic
cuuauauuuuuauuuuug

SEQ ID NO: 23933 - RNA, 19 nt, Artificial Sequence
  Synthetic
acuuauauuuuuauuuuug

SEQ ID NO: 23934 - RNA, 20 nt, Artificial Sequence
  Synthetic
cacuuauauuuuuauuuuug

SEQ ID NO: 23935 - RNA, 21 nt, Artificial Sequence
  Synthetic
ccacuuauauuuuuauuuuug

SEQ ID NO: 23936 - RNA, 22 nt, Artificial Sequence
  Synthetic
gccacuuauauuuuuauuuuug

SEQ ID NO: 23937 - RNA, 23 nt, Artificial Sequence
  Synthetic
ggccacuuauauuuuuauuuuug

SEQ ID NO: 23938 - RNA, 24 nt, Artificial Sequence
  Synthetic
aggccacuuauauuuuuauuuuug

SEQ ID NO: 23939 - RNA, 18 nt, Artificial Sequence
  Synthetic
uuuuguuuguguuuuuug

SEQ ID NO: 23940 - RNA, 19 nt, Artificial Sequence
  Synthetic
cuuuuguuuguguuuuuug

SEQ ID NO: 23941 - RNA, 20 nt, Artificial Sequence
  Synthetic
ucuuuuguuuguguuuuuug

SEQ ID NO: 23942 - RNA, 21 nt, Artificial Sequence
  Synthetic
uucuuuuguuuguguuuuuug

SEQ ID NO: 23943 - RNA, 22 nt, Artificial Sequence
  Synthetic
uuucuuuuguuuguguuuuuug

SEQ ID NO: 23944 - RNA, 23 nt, Artificial Sequence
  Synthetic
uuuucuuuuguuuguguuuuuug

SEQ ID NO: 23945 - RNA, 24 nt, Artificial Sequence
  Synthetic
auuuucuuuuguuuguguuuuuug

SEQ ID NO: 23946 - RNA, 18 nt, Artificial Sequence
  Synthetic
cuaaaaugacaaucaaau

SEQ ID NO: 23947 - RNA, 19 nt, Artificial Sequence
  Synthetic
gcuaaaaugacaaucaaau

SEQ ID NO: 23948 - RNA, 21 nt, Artificial Sequence
  Synthetic
cagcuaaaaugacaaucaaau

SEQ ID NO: 23949 - RNA, 22 nt, Artificial Sequence
  Synthetic
acagcuaaaaugacaaucaaau

SEQ ID NO: 23950 - RNA, 23 nt, Artificial Sequence
  Synthetic
cacagcuaaaaugacaaucaaau

SEQ ID NO: 23951 - RNA, 24 nt, Artificial Sequence
  Synthetic
ccacagcuaaaaugacaaucaaau

SEQ ID NO: 23952 - RNA, 18 nt, Artificial Sequence
  Synthetic
aacaauacaaagauaaau

SEQ ID NO: 23953 - RNA, 19 nt, Artificial Sequence
  Synthetic
uaacaauacaaagauaaau

SEQ ID NO: 23954 - RNA, 20 nt, Artificial Sequence
  Synthetic
uuaacaauacaaagauaaau

SEQ ID NO: 23955 - RNA, 21 nt, Artificial Sequence
  Synthetic
uuuaacaauacaaagauaaau

SEQ ID NO: 23956 - RNA, 22 nt, Artificial Sequence
  Synthetic
auuuaacaauacaaagauaaau

SEQ ID NO: 23957 - RNA, 23 nt, Artificial Sequence
  Synthetic
gauuuaacaauacaaagauaaau

SEQ ID NO: 23958 - RNA, 24 nt, Artificial Sequence
  Synthetic
agauuuaacaauacaaagauaaau

SEQ ID NO: 23959 - RNA, 18 nt, Artificial Sequence
  Synthetic
guuauauguccugacaau

SEQ ID NO: 23960 - RNA, 19 nt, Artificial Sequence
  Synthetic
uguuauauguccugacaau

SEQ ID NO: 23961 - RNA, 20 nt, Artificial Sequence
  Synthetic
auguuauauguccugacaau

SEQ ID NO: 23962 - RNA, 21 nt, Artificial Sequence
  Synthetic
uauguuauauguccugacaau

SEQ ID NO: 23963 - RNA, 22 nt, Artificial Sequence
  Synthetic
auauguuauauguccugacaau

SEQ ID NO: 23964 - RNA, 23 nt, Artificial Sequence
  Synthetic
aauauguuauauguccugacaau

SEQ ID NO: 23965 - RNA, 24 nt, Artificial Sequence
  Synthetic
aaauauguuauauguccugacaau

SEQ ID NO: 23966 - RNA, 18 nt, Artificial Sequence
  Synthetic
gugcuauuuaaacagaau

SEQ ID NO: 23967 - RNA, 19 nt, Artificial Sequence
  Synthetic
agugcuauuuaaacagaau

SEQ ID NO: 23968 - RNA, 20 nt, Artificial Sequence
  Synthetic
cagugcuauuuaaacagaau

SEQ ID NO: 23969 - RNA, 21 nt, Artificial Sequence
  Synthetic
ccagugcuauuuaaacagaau

SEQ ID NO: 23970 - RNA, 22 nt, Artificial Sequence
  Synthetic
uccagugcuauuuaaacagaau

SEQ ID NO: 23971 - RNA, 23 nt, Artificial Sequence
  Synthetic
cuccagugcuauuuaaacagaau

SEQ ID NO: 23972 - RNA, 24 nt, Artificial Sequence
  Synthetic
acuccagugcuauuuaaacagaau

SEQ ID NO: 23973 - RNA, 18 nt, Artificial Sequence
  Synthetic
guccucugugcuuugaau

SEQ ID NO: 23974 - RNA, 19 nt, Artificial Sequence
  Synthetic
aguccucugugcuuugaau

SEQ ID NO: 23975 - RNA, 20 nt, Artificial Sequence
  Synthetic
aaguccucugugcuuugaau

SEQ ID NO: 23976 - RNA, 21 nt, Artificial Sequence
  Synthetic
caaguccucugugcuuugaau

SEQ ID NO: 23977 - RNA, 22 nt, Artificial Sequence
  Synthetic
gcaaguccucugugcuuugaau

SEQ ID NO: 23978 - RNA, 23 nt, Artificial Sequence
  Synthetic
ugcaaguccucugugcuuugaau

SEQ ID NO: 23979 - RNA, 24 nt, Artificial Sequence
  Synthetic
gugcaaguccucugugcuuugaau

SEQ ID NO: 23980 - RNA, 18 nt, Artificial Sequence
  Synthetic
ccaagcaguagaaauaau

SEQ ID NO: 23981 - RNA, 19 nt, Artificial Sequence
  Synthetic
uccaagcaguagaaauaau

SEQ ID NO: 23982 - RNA, 20 nt, Artificial Sequence
  Synthetic
uuccaagcaguagaaauaau

SEQ ID NO: 23983 - RNA, 21 nt, Artificial Sequence
  Synthetic
auuccaagcaguagaaauaau

SEQ ID NO: 23984 - RNA, 22 nt, Artificial Sequence
  Synthetic
aauuccaagcaguagaaauaau

SEQ ID NO: 23985 - RNA, 23 nt, Artificial Sequence
  Synthetic
aaauuccaagcaguagaaauaau

SEQ ID NO: 23986 - RNA, 24 nt, Artificial Sequence
  Synthetic
aaaauuccaagcaguagaaauaau

SEQ ID NO: 23987 - RNA, 18 nt, Artificial Sequence
  Synthetic
uuuuaguagaaaccuaau

SEQ ID NO: 23988 - RNA, 19 nt, Artificial Sequence
  Synthetic
guuuuaguagaaaccuaau

SEQ ID NO: 23989 - RNA, 20 nt, Artificial Sequence
  Synthetic
gguuuuaguagaaaccuaau

SEQ ID NO: 23990 - RNA, 21 nt, Artificial Sequence
  Synthetic
ugguuuuaguagaaaccuaau

SEQ ID NO: 23991 - RNA, 22 nt, Artificial Sequence
  Synthetic
uugguuuuaguagaaaccuaau

SEQ ID NO: 23992 - RNA, 23 nt, Artificial Sequence
  Synthetic
uuugguuuuaguagaaaccuaau

SEQ ID NO: 23993 - RNA, 24 nt, Artificial Sequence
  Synthetic
guuugguuuuaguagaaaccuaau

SEQ ID NO: 23994 - RNA, 18 nt, Artificial Sequence
  Synthetic
gccuagaugauuauuaau

SEQ ID NO: 23995 - RNA, 19 nt, Artificial Sequence
  Synthetic
agccuagaugauuauuaau

SEQ ID NO: 23996 - RNA, 21 nt, Artificial Sequence
  Synthetic
gcagccuagaugauuauuaau

SEQ ID NO: 23997 - RNA, 22 nt, Artificial Sequence
  Synthetic
ugcagccuagaugauuauuaau

SEQ ID NO: 23998 - RNA, 23 nt, Artificial Sequence
  Synthetic
uugcagccuagaugauuauuaau

SEQ ID NO: 23999 - RNA, 24 nt, Artificial Sequence
  Synthetic
uuugcagccuagaugauuauuaau

SEQ ID NO: 24000 - RNA, 18 nt, Artificial Sequence
  Synthetic
uuacaauucuuauuacau

SEQ ID NO: 24001 - RNA, 19 nt, Artificial Sequence
  Synthetic
uuuacaauucuuauuacau

SEQ ID NO: 24002 - RNA, 21 nt, Artificial Sequence
  Synthetic
auuuuacaauucuuauuacau

SEQ ID NO: 24003 - RNA, 22 nt, Artificial Sequence
  Synthetic
aauuuuacaauucuuauuacau

SEQ ID NO: 24004 - RNA, 23 nt, Artificial Sequence
  Synthetic
aaauuuuacaauucuuauuacau

SEQ ID NO: 24005 - RNA, 24 nt, Artificial Sequence
  Synthetic
uaaauuuuacaauucuuauuacau

SEQ ID NO: 24006 - RNA, 18 nt, Artificial Sequence
  Synthetic
agguauagucagucccau

SEQ ID NO: 24007 - RNA, 19 nt, Artificial Sequence
  Synthetic
cagguauagucagucccau

SEQ ID NO: 24008 - RNA, 20 nt, Artificial Sequence
  Synthetic
acagguauagucagucccau

SEQ ID NO: 24009 - RNA, 21 nt, Artificial Sequence
  Synthetic
gacagguauagucagucccau

SEQ ID NO: 24010 - RNA, 22 nt, Artificial Sequence
  Synthetic
agacagguauagucagucccau

SEQ ID NO: 24011 - RNA, 23 nt, Artificial Sequence
  Synthetic
cagacagguauagucagucccau

SEQ ID NO: 24012 - RNA, 24 nt, Artificial Sequence
  Synthetic
ccagacagguauagucagucccau

SEQ ID NO: 24013 - RNA, 18 nt, Artificial Sequence
  Synthetic
aacauagagaaaacucau

SEQ ID NO: 24014 - RNA, 19 nt, Artificial Sequence
  Synthetic
aaacauagagaaaacucau

SEQ ID NO: 24015 - RNA, 20 nt, Artificial Sequence
  Synthetic
aaaacauagagaaaacucau

SEQ ID NO: 24016 - RNA, 21 nt, Artificial Sequence
  Synthetic
uaaaacauagagaaaacucau

SEQ ID NO: 24017 - RNA, 22 nt, Artificial Sequence
  Synthetic
auaaaacauagagaaaacucau

SEQ ID NO: 24018 - RNA, 23 nt, Artificial Sequence
  Synthetic
aauaaaacauagagaaaacucau

SEQ ID NO: 24019 - RNA, 24 nt, Artificial Sequence
  Synthetic
aaauaaaacauagagaaaacucau

SEQ ID NO: 24020 - RNA, 18 nt, Artificial Sequence
  Synthetic
cuauuuucccuauaagau

SEQ ID NO: 24021 - RNA, 19 nt, Artificial Sequence
  Synthetic
acuauuuucccuauaagau

SEQ ID NO: 24022 - RNA, 20 nt, Artificial Sequence
  Synthetic
uacuauuuucccuauaagau

SEQ ID NO: 24023 - RNA, 21 nt, Artificial Sequence
  Synthetic
auacuauuuucccuauaagau

SEQ ID NO: 24024 - RNA, 22 nt, Artificial Sequence
  Synthetic
cauacuauuuucccuauaagau

SEQ ID NO: 24025 - RNA, 23 nt, Artificial Sequence
  Synthetic
acauacuauuuucccuauaagau

SEQ ID NO: 24026 - RNA, 24 nt, Artificial Sequence
  Synthetic
gacauacuauuuucccuauaagau

SEQ ID NO: 24027 - RNA, 18 nt, Artificial Sequence
  Synthetic
aauggaaaauggacagau

SEQ ID NO: 24028 - RNA, 19 nt, Artificial Sequence
  Synthetic
gaauggaaaauggacagau

SEQ ID NO: 24029 - RNA, 20 nt, Artificial Sequence
  Synthetic
agaauggaaaauggacagau

SEQ ID NO: 24030 - RNA, 21 nt, Artificial Sequence
  Synthetic
gagaauggaaaauggacagau

SEQ ID NO: 24031 - RNA, 22 nt, Artificial Sequence
  Synthetic
ggagaauggaaaauggacagau

SEQ ID NO: 24032 - RNA, 23 nt, Artificial Sequence
  Synthetic
aggagaauggaaaauggacagau

SEQ ID NO: 24033 - RNA, 24 nt, Artificial Sequence
  Synthetic
caggagaauggaaaauggacagau

SEQ ID NO: 24034 - RNA, 18 nt, Artificial Sequence
  Synthetic
uuguucuuagggugggau

SEQ ID NO: 24035 - RNA, 19 nt, Artificial Sequence
  Synthetic
guuguucuuagggugggau

SEQ ID NO: 24036 - RNA, 20 nt, Artificial Sequence
  Synthetic
aguuguucuuagggugggau

SEQ ID NO: 24037 - RNA, 21 nt, Artificial Sequence
  Synthetic
aaguuguucuuagggugggau

SEQ ID NO: 24038 - RNA, 22 nt, Artificial Sequence
  Synthetic
uaaguuguucuuagggugggau

SEQ ID NO: 24039 - RNA, 23 nt, Artificial Sequence
  Synthetic
uuaaguuguucuuagggugggau

SEQ ID NO: 24040 - RNA, 24 nt, Artificial Sequence
  Synthetic
guuaaguuguucuuagggugggau

SEQ ID NO: 24041 - RNA, 18 nt, Artificial Sequence
  Synthetic
uggcuaccuugguuggau

SEQ ID NO: 24042 - RNA, 19 nt, Artificial Sequence
  Synthetic
uuggcuaccuugguuggau

SEQ ID NO: 24043 - RNA, 20 nt, Artificial Sequence
  Synthetic
auuggcuaccuugguuggau

SEQ ID NO: 24044 - RNA, 21 nt, Artificial Sequence
  Synthetic
gauuggcuaccuugguuggau

SEQ ID NO: 24045 - RNA, 22 nt, Artificial Sequence
  Synthetic
ggauuggcuaccuugguuggau

SEQ ID NO: 24046 - RNA, 23 nt, Artificial Sequence
  Synthetic
uggauuggcuaccuugguuggau

SEQ ID NO: 24047 - RNA, 24 nt, Artificial Sequence
  Synthetic
cuggauuggcuaccuugguuggau

SEQ ID NO: 24048 - RNA, 18 nt, Artificial Sequence
  Synthetic
aaacaugaugaaaaauau

SEQ ID NO: 24049 - RNA, 19 nt, Artificial Sequence
  Synthetic
uaaacaugaugaaaaauau

SEQ ID NO: 24050 - RNA, 20 nt, Artificial Sequence
  Synthetic
cuaaacaugaugaaaaauau

SEQ ID NO: 24051 - RNA, 21 nt, Artificial Sequence
  Synthetic
acuaaacaugaugaaaaauau

SEQ ID NO: 24052 - RNA, 22 nt, Artificial Sequence
  Synthetic
cacuaaacaugaugaaaaauau

SEQ ID NO: 24053 - RNA, 23 nt, Artificial Sequence
  Synthetic
gcacuaaacaugaugaaaaauau

SEQ ID NO: 24054 - RNA, 24 nt, Artificial Sequence
  Synthetic
ugcacuaaacaugaugaaaaauau

SEQ ID NO: 24055 - RNA, 18 nt, Artificial Sequence
  Synthetic
uuuguguuaacaaaauau

SEQ ID NO: 24056 - RNA, 19 nt, Artificial Sequence
  Synthetic
cuuuguguuaacaaaauau

SEQ ID NO: 24057 - RNA, 21 nt, Artificial Sequence
  Synthetic
uucuuuguguuaacaaaauau

SEQ ID NO: 24058 - RNA, 22 nt, Artificial Sequence
  Synthetic
guucuuuguguuaacaaaauau

SEQ ID NO: 24059 - RNA, 23 nt, Artificial Sequence
  Synthetic
uguucuuuguguuaacaaaauau

SEQ ID NO: 24060 - RNA, 24 nt, Artificial Sequence
  Synthetic
uuguucuuuguguuaacaaaauau

SEQ ID NO: 24061 - RNA, 18 nt, Artificial Sequence
  Synthetic
guugcaaaaauacgauau

SEQ ID NO: 24062 - RNA, 19 nt, Artificial Sequence
  Synthetic
aguugcaaaaauacgauau

SEQ ID NO: 24063 - RNA, 20 nt, Artificial Sequence
  Synthetic
gaguugcaaaaauacgauau

SEQ ID NO: 24064 - RNA, 21 nt, Artificial Sequence
  Synthetic
ggaguugcaaaaauacgauau

SEQ ID NO: 24065 - RNA, 22 nt, Artificial Sequence
  Synthetic
aggaguugcaaaaauacgauau

SEQ ID NO: 24066 - RNA, 23 nt, Artificial Sequence
  Synthetic
aaggaguugcaaaaauacgauau

SEQ ID NO: 24067 - RNA, 24 nt, Artificial Sequence
  Synthetic
aaaggaguugcaaaaauacgauau

SEQ ID NO: 24068 - RNA, 18 nt, Artificial Sequence
  Synthetic
aaaaauuacagaaccuau

SEQ ID NO: 24069 - RNA, 19 nt, Artificial Sequence
  Synthetic
caaaaauuacagaaccuau

SEQ ID NO: 24070 - RNA, 20 nt, Artificial Sequence
  Synthetic
gcaaaaauuacagaaccuau

SEQ ID NO: 24071 - RNA, 21 nt, Artificial Sequence
  Synthetic
agcaaaaauuacagaaccuau

SEQ ID NO: 24072 - RNA, 22 nt, Artificial Sequence
  Synthetic
aagcaaaaauuacagaaccuau

SEQ ID NO: 24073 - RNA, 23 nt, Artificial Sequence
  Synthetic
gaagcaaaaauuacagaaccuau

SEQ ID NO: 24074 - RNA, 24 nt, Artificial Sequence
  Synthetic
ugaagcaaaaauuacagaaccuau

SEQ ID NO: 24075 - RNA, 18 nt, Artificial Sequence
  Synthetic
aaaugcuugaccacuuau

SEQ ID NO: 24076 - RNA, 19 nt, Artificial Sequence
  Synthetic
caaaugcuugaccacuuau

SEQ ID NO: 24077 - RNA, 21 nt, Artificial Sequence
  Synthetic
cacaaaugcuugaccacuuau

SEQ ID NO: 24078 - RNA, 22 nt, Artificial Sequence
  Synthetic
acacaaaugcuugaccacuuau

SEQ ID NO: 24079 - RNA, 23 nt, Artificial Sequence
  Synthetic
uacacaaaugcuugaccacuuau

SEQ ID NO: 24080 - RNA, 24 nt, Artificial Sequence
  Synthetic
guacacaaaugcuugaccacuuau

SEQ ID NO: 24081 - RNA, 18 nt, Artificial Sequence
  Synthetic
aaaaagcacugauuuuau

SEQ ID NO: 24082 - RNA, 19 nt, Artificial Sequence
  Synthetic
gaaaaagcacugauuuuau

SEQ ID NO: 24083 - RNA, 20 nt, Artificial Sequence
  Synthetic
cgaaaaagcacugauuuuau

SEQ ID NO: 24084 - RNA, 21 nt, Artificial Sequence
  Synthetic
ucgaaaaagcacugauuuuau

SEQ ID NO: 24085 - RNA, 22 nt, Artificial Sequence
  Synthetic
cucgaaaaagcacugauuuuau

SEQ ID NO: 24086 - RNA, 23 nt, Artificial Sequence
  Synthetic
ccucgaaaaagcacugauuuuau

SEQ ID NO: 24087 - RNA, 24 nt, Artificial Sequence
  Synthetic
accucgaaaaagcacugauuuuau

SEQ ID NO: 24088 - RNA, 18 nt, Artificial Sequence
  Synthetic
acaaagauuuauauaacu

SEQ ID NO: 24089 - RNA, 19 nt, Artificial Sequence
  Synthetic
aacaaagauuuauauaacu

SEQ ID NO: 24090 - RNA, 20 nt, Artificial Sequence
  Synthetic
gaacaaagauuuauauaacu

SEQ ID NO: 24091 - RNA, 21 nt, Artificial Sequence
  Synthetic
ugaacaaagauuuauauaacu

SEQ ID NO: 24092 - RNA, 22 nt, Artificial Sequence
  Synthetic
gugaacaaagauuuauauaacu

SEQ ID NO: 24093 - RNA, 23 nt, Artificial Sequence
  Synthetic
agugaacaaagauuuauauaacu

SEQ ID NO: 24094 - RNA, 24 nt, Artificial Sequence
  Synthetic
cagugaacaaagauuuauauaacu

SEQ ID NO: 24095 - RNA, 18 nt, Artificial Sequence
  Synthetic
gccuguaaucccaacacu

SEQ ID NO: 24096 - RNA, 19 nt, Artificial Sequence
  Synthetic
ugccuguaaucccaacacu

SEQ ID NO: 24097 - RNA, 20 nt, Artificial Sequence
  Synthetic
augccuguaaucccaacacu

SEQ ID NO: 24098 - RNA, 21 nt, Artificial Sequence
  Synthetic
caugccuguaaucccaacacu

SEQ ID NO: 24099 - RNA, 22 nt, Artificial Sequence
  Synthetic
ucaugccuguaaucccaacacu

SEQ ID NO: 24100 - RNA, 23 nt, Artificial Sequence
  Synthetic
cucaugccuguaaucccaacacu

SEQ ID NO: 24101 - RNA, 24 nt, Artificial Sequence
  Synthetic
gcucaugccuguaaucccaacacu

SEQ ID NO: 24102 - RNA, 18 nt, Artificial Sequence
  Synthetic
gccuauaaacccagcacu

SEQ ID NO: 24103 - RNA, 19 nt, Artificial Sequence
  Synthetic
ugccuauaaacccagcacu

SEQ ID NO: 24104 - RNA, 20 nt, Artificial Sequence
  Synthetic
augccuauaaacccagcacu

SEQ ID NO: 24105 - RNA, 21 nt, Artificial Sequence
  Synthetic
caugccuauaaacccagcacu

SEQ ID NO: 24106 - RNA, 22 nt, Artificial Sequence
  Synthetic
ucaugccuauaaacccagcacu

SEQ ID NO: 24107 - RNA, 23 nt, Artificial Sequence
  Synthetic
cucaugccuauaaacccagcacu

SEQ ID NO: 24108 - RNA, 24 nt, Artificial Sequence
  Synthetic
gcucaugccuauaaacccagcacu

SEQ ID NO: 24109 - RNA, 18 nt, Artificial Sequence
  Synthetic
gccuguaaucccagcacu

SEQ ID NO: 24110 - RNA, 19 nt, Artificial Sequence
  Synthetic
cgccuguaaucccagcacu

SEQ ID NO: 24111 - RNA, 20 nt, Artificial Sequence
  Synthetic
acgccuguaaucccagcacu

SEQ ID NO: 24112 - RNA, 21 nt, Artificial Sequence
  Synthetic
cacgccuguaaucccagcacu

SEQ ID NO: 24113 - RNA, 22 nt, Artificial Sequence
  Synthetic
ucacgccuguaaucccagcacu

SEQ ID NO: 24114 - RNA, 23 nt, Artificial Sequence
  Synthetic
cucacgccuguaaucccagcacu

SEQ ID NO: 24115 - RNA, 24 nt, Artificial Sequence
  Synthetic
gcucacgccuguaaucccagcacu

SEQ ID NO: 24116 - RNA, 18 nt, Artificial Sequence
  Synthetic
ucccgaguagcugggacu

SEQ ID NO: 24117 - RNA, 19 nt, Artificial Sequence
  Synthetic
cucccgaguagcugggacu

SEQ ID NO: 24118 - RNA, 20 nt, Artificial Sequence
  Synthetic
ccucccgaguagcugggacu

SEQ ID NO: 24119 - RNA, 21 nt, Artificial Sequence
  Synthetic
gccucccgaguagcugggacu

SEQ ID NO: 24120 - RNA, 22 nt, Artificial Sequence
  Synthetic
agccucccgaguagcugggacu

SEQ ID NO: 24121 - RNA, 23 nt, Artificial Sequence
  Synthetic
cagccucccgaguagcugggacu

SEQ ID NO: 24122 - RNA, 24 nt, Artificial Sequence
  Synthetic
ucagccucccgaguagcugggacu

SEQ ID NO: 24123 - RNA, 21 nt, Artificial Sequence
  Synthetic
gcgccuguagucccagcuacu

SEQ ID NO: 24124 - RNA, 22 nt, Artificial Sequence
  Synthetic
ggcgccuguagucccagcuacu

SEQ ID NO: 24125 - RNA, 23 nt, Artificial Sequence
  Synthetic
gggcgccuguagucccagcuacu

SEQ ID NO: 24126 - RNA, 24 nt, Artificial Sequence
  Synthetic
cgggcgccuguagucccagcuacu

SEQ ID NO: 24127 - RNA, 22 nt, Artificial Sequence
  Synthetic
cgugccuguagucccagcuacu

SEQ ID NO: 24128 - RNA, 23 nt, Artificial Sequence
  Synthetic
gcgugccuguagucccagcuacu

SEQ ID NO: 24129 - RNA, 24 nt, Artificial Sequence
  Synthetic
ugcgugccuguagucccagcuacu

SEQ ID NO: 24130 - RNA, 18 nt, Artificial Sequence
  Synthetic
cuugcuucaccugcuacu

SEQ ID NO: 24131 - RNA, 19 nt, Artificial Sequence
  Synthetic
acuugcuucaccugcuacu

SEQ ID NO: 24132 - RNA, 21 nt, Artificial Sequence
  Synthetic
gcacuugcuucaccugcuacu

SEQ ID NO: 24133 - RNA, 22 nt, Artificial Sequence
  Synthetic
ugcacuugcuucaccugcuacu

SEQ ID NO: 24134 - RNA, 23 nt, Artificial Sequence
  Synthetic
uugcacuugcuucaccugcuacu

SEQ ID NO: 24135 - RNA, 24 nt, Artificial Sequence
  Synthetic
uuugcacuugcuucaccugcuacu

SEQ ID NO: 24136 - RNA, 18 nt, Artificial Sequence
  Synthetic
aaucuuauagagauuacu

SEQ ID NO: 24137 - RNA, 19 nt, Artificial Sequence
  Synthetic
aaaucuuauagagauuacu

SEQ ID NO: 24138 - RNA, 21 nt, Artificial Sequence
  Synthetic
caaaaucuuauagagauuacu

SEQ ID NO: 24139 - RNA, 22 nt, Artificial Sequence
  Synthetic
acaaaaucuuauagagauuacu

SEQ ID NO: 24140 - RNA, 23 nt, Artificial Sequence
  Synthetic
aacaaaaucuuauagagauuacu

SEQ ID NO: 24141 - RNA, 24 nt, Artificial Sequence
  Synthetic
uaacaaaaucuuauagagauuacu

SEQ ID NO: 24142 - RNA, 18 nt, Artificial Sequence
  Synthetic
ccugcaauaccaucaccu

SEQ ID NO: 24143 - RNA, 19 nt, Artificial Sequence
  Synthetic
cccugcaauaccaucaccu

SEQ ID NO: 24144 - RNA, 21 nt, Artificial Sequence
  Synthetic
cacccugcaauaccaucaccu

SEQ ID NO: 24145 - RNA, 22 nt, Artificial Sequence
  Synthetic
ccacccugcaauaccaucaccu

SEQ ID NO: 24146 - RNA, 23 nt, Artificial Sequence
  Synthetic
cccacccugcaauaccaucaccu

SEQ ID NO: 24147 - RNA, 24 nt, Artificial Sequence
  Synthetic
ccccacccugcaauaccaucaccu

SEQ ID NO: 24148 - RNA, 18 nt, Artificial Sequence
  Synthetic
aacucauaagggaccgcu

SEQ ID NO: 24149 - RNA, 19 nt, Artificial Sequence
  Synthetic
aaacucauaagggaccgcu

SEQ ID NO: 24150 - RNA, 21 nt, Artificial Sequence
  Synthetic
gaaaacucauaagggaccgcu

SEQ ID NO: 24151 - RNA, 22 nt, Artificial Sequence
  Synthetic
agaaaacucauaagggaccgcu

SEQ ID NO: 24152 - RNA, 23 nt, Artificial Sequence
  Synthetic
gagaaaacucauaagggaccgcu

SEQ ID NO: 24153 - RNA, 24 nt, Artificial Sequence
  Synthetic
agagaaaacucauaagggaccgcu

SEQ ID NO: 24154 - RNA, 18 nt, Artificial Sequence
  Synthetic
cucacaguucuggaggcu

SEQ ID NO: 24155 - RNA, 19 nt, Artificial Sequence
  Synthetic
ucucacaguucuggaggcu

SEQ ID NO: 24156 - RNA, 21 nt, Artificial Sequence
  Synthetic
uuucucacaguucuggaggcu

SEQ ID NO: 24157 - RNA, 22 nt, Artificial Sequence
  Synthetic
auuucucacaguucuggaggcu

SEQ ID NO: 24158 - RNA, 23 nt, Artificial Sequence
  Synthetic
uauuucucacaguucuggaggcu

SEQ ID NO: 24159 - RNA, 24 nt, Artificial Sequence
  Synthetic
uuauuucucacaguucuggaggcu

SEQ ID NO: 24160 - RNA, 18 nt, Artificial Sequence
  Synthetic
ucaucuguuaguaaugcu

SEQ ID NO: 24161 - RNA, 19 nt, Artificial Sequence
  Synthetic
aucaucuguuaguaaugcu

SEQ ID NO: 24162 - RNA, 20 nt, Artificial Sequence
  Synthetic
uaucaucuguuaguaaugcu

SEQ ID NO: 24163 - RNA, 21 nt, Artificial Sequence
  Synthetic
auaucaucuguuaguaaugcu

SEQ ID NO: 24164 - RNA, 22 nt, Artificial Sequence
  Synthetic
aauaucaucuguuaguaaugcu

SEQ ID NO: 24165 - RNA, 23 nt, Artificial Sequence
  Synthetic
uaauaucaucuguuaguaaugcu

SEQ ID NO: 24166 - RNA, 24 nt, Artificial Sequence
  Synthetic
auaauaucaucuguuaguaaugcu

SEQ ID NO: 24167 - RNA, 18 nt, Artificial Sequence
  Synthetic
agcagauuugggucugcu

SEQ ID NO: 24168 - RNA, 19 nt, Artificial Sequence
  Synthetic
cagcagauuugggucugcu

SEQ ID NO: 24169 - RNA, 20 nt, Artificial Sequence
  Synthetic
ccagcagauuugggucugcu

SEQ ID NO: 24170 - RNA, 21 nt, Artificial Sequence
  Synthetic
gccagcagauuugggucugcu

SEQ ID NO: 24171 - RNA, 22 nt, Artificial Sequence
  Synthetic
ugccagcagauuugggucugcu

SEQ ID NO: 24172 - RNA, 23 nt, Artificial Sequence
  Synthetic
gugccagcagauuugggucugcu

SEQ ID NO: 24173 - RNA, 24 nt, Artificial Sequence
  Synthetic
ggugccagcagauuugggucugcu

SEQ ID NO: 24174 - RNA, 18 nt, Artificial Sequence
  Synthetic
auauagagagaaacaucu

SEQ ID NO: 24175 - RNA, 19 nt, Artificial Sequence
  Synthetic
uauauagagagaaacaucu

SEQ ID NO: 24176 - RNA, 20 nt, Artificial Sequence
  Synthetic
auauauagagagaaacaucu

SEQ ID NO: 24177 - RNA, 21 nt, Artificial Sequence
  Synthetic
uauauauagagagaaacaucu

SEQ ID NO: 24178 - RNA, 22 nt, Artificial Sequence
  Synthetic
auauauauagagagaaacaucu

SEQ ID NO: 24179 - RNA, 23 nt, Artificial Sequence
  Synthetic
uauauauauagagagaaacaucu

SEQ ID NO: 24180 - RNA, 24 nt, Artificial Sequence
  Synthetic
uuauauauauagagagaaacaucu

SEQ ID NO: 24181 - RNA, 18 nt, Artificial Sequence
  Synthetic
auagagagaaacaucucu

SEQ ID NO: 24182 - RNA, 19 nt, Artificial Sequence
  Synthetic
uauagagagaaacaucucu

SEQ ID NO: 24183 - RNA, 21 nt, Artificial Sequence
  Synthetic
uauauagagagaaacaucucu

SEQ ID NO: 24184 - RNA, 22 nt, Artificial Sequence
  Synthetic
auauauagagagaaacaucucu

SEQ ID NO: 24185 - RNA, 23 nt, Artificial Sequence
  Synthetic
uauauauagagagaaacaucucu

SEQ ID NO: 24186 - RNA, 24 nt, Artificial Sequence
  Synthetic
auauauauagagagaaacaucucu

SEQ ID NO: 24187 - RNA, 18 nt, Artificial Sequence
  Synthetic
auuaauuuuaaaaauucu

SEQ ID NO: 24188 - RNA, 19 nt, Artificial Sequence
  Synthetic
aauuaauuuuaaaaauucu

SEQ ID NO: 24189 - RNA, 20 nt, Artificial Sequence
  Synthetic
gaauuaauuuuaaaaauucu

SEQ ID NO: 24190 - RNA, 21 nt, Artificial Sequence
  Synthetic
agaauuaauuuuaaaaauucu

SEQ ID NO: 24191 - RNA, 22 nt, Artificial Sequence
  Synthetic
cagaauuaauuuuaaaaauucu

SEQ ID NO: 24192 - RNA, 23 nt, Artificial Sequence
  Synthetic
gcagaauuaauuuuaaaaauucu

SEQ ID NO: 24193 - RNA, 24 nt, Artificial Sequence
  Synthetic
cgcagaauuaauuuuaaaaauucu

SEQ ID NO: 24194 - RNA, 18 nt, Artificial Sequence
  Synthetic
uaauuugaacaacauucu

SEQ ID NO: 24195 - RNA, 19 nt, Artificial Sequence
  Synthetic
auaauuugaacaacauucu

SEQ ID NO: 24196 - RNA, 21 nt, Artificial Sequence
  Synthetic
aaauaauuugaacaacauucu

SEQ ID NO: 24197 - RNA, 22 nt, Artificial Sequence
  Synthetic
gaaauaauuugaacaacauucu

SEQ ID NO: 24198 - RNA, 23 nt, Artificial Sequence
  Synthetic
agaaauaauuugaacaacauucu

SEQ ID NO: 24199 - RNA, 24 nt, Artificial Sequence
  Synthetic
uagaaauaauuugaacaacauucu

SEQ ID NO: 24200 - RNA, 18 nt, Artificial Sequence
  Synthetic
uuaguaaacuccguuucu

SEQ ID NO: 24201 - RNA, 19 nt, Artificial Sequence
  Synthetic
guuaguaaacuccguuucu

SEQ ID NO: 24202 - RNA, 20 nt, Artificial Sequence
  Synthetic
aguuaguaaacuccguuucu

SEQ ID NO: 24203 - RNA, 21 nt, Artificial Sequence
  Synthetic
gaguuaguaaacuccguuucu

SEQ ID NO: 24204 - RNA, 22 nt, Artificial Sequence
  Synthetic
ugaguuaguaaacuccguuucu

SEQ ID NO: 24205 - RNA, 23 nt, Artificial Sequence
  Synthetic
uugaguuaguaaacuccguuucu

SEQ ID NO: 24206 - RNA, 24 nt, Artificial Sequence
  Synthetic
auugaguuaguaaacuccguuucu

SEQ ID NO: 24207 - RNA, 18 nt, Artificial Sequence
  Synthetic
ccugacaauaagaaaagu

SEQ ID NO: 24208 - RNA, 19 nt, Artificial Sequence
  Synthetic
uccugacaauaagaaaagu

SEQ ID NO: 24209 - RNA, 20 nt, Artificial Sequence
  Synthetic
guccugacaauaagaaaagu

SEQ ID NO: 24210 - RNA, 21 nt, Artificial Sequence
  Synthetic
uguccugacaauaagaaaagu

SEQ ID NO: 24211 - RNA, 22 nt, Artificial Sequence
  Synthetic
auguccugacaauaagaaaagu

SEQ ID NO: 24212 - RNA, 23 nt, Artificial Sequence
  Synthetic
uauguccugacaauaagaaaagu

SEQ ID NO: 24213 - RNA, 24 nt, Artificial Sequence
  Synthetic
auauguccugacaauaagaaaagu

SEQ ID NO: 24214 - RNA, 18 nt, Artificial Sequence
  Synthetic
agugcuaggauuacaagu

SEQ ID NO: 24215 - RNA, 19 nt, Artificial Sequence
  Synthetic
aagugcuaggauuacaagu

SEQ ID NO: 24216 - RNA, 20 nt, Artificial Sequence
  Synthetic
aaagugcuaggauuacaagu

SEQ ID NO: 24217 - RNA, 21 nt, Artificial Sequence
  Synthetic
aaaagugcuaggauuacaagu

SEQ ID NO: 24218 - RNA, 22 nt, Artificial Sequence
  Synthetic
caaaagugcuaggauuacaagu

SEQ ID NO: 24219 - RNA, 23 nt, Artificial Sequence
  Synthetic
ccaaaagugcuaggauuacaagu

SEQ ID NO: 24220 - RNA, 24 nt, Artificial Sequence
  Synthetic
uccaaaagugcuaggauuacaagu

SEQ ID NO: 24221 - RNA, 18 nt, Artificial Sequence
  Synthetic
aggaaaugggguauaagu

SEQ ID NO: 24222 - RNA, 19 nt, Artificial Sequence
  Synthetic
aaggaaaugggguauaagu

SEQ ID NO: 24223 - RNA, 20 nt, Artificial Sequence
  Synthetic
aaaggaaaugggguauaagu

SEQ ID NO: 24224 - RNA, 21 nt, Artificial Sequence
  Synthetic
caaaggaaaugggguauaagu

SEQ ID NO: 24225 - RNA, 22 nt, Artificial Sequence
  Synthetic
acaaaggaaaugggguauaagu

SEQ ID NO: 24226 - RNA, 23 nt, Artificial Sequence
  Synthetic
aacaaaggaaaugggguauaagu

SEQ ID NO: 24227 - RNA, 24 nt, Artificial Sequence
  Synthetic
aaacaaaggaaaugggguauaagu

SEQ ID NO: 24228 - RNA, 18 nt, Artificial Sequence
  Synthetic
acagaaauauucagcagu

SEQ ID NO: 24229 - RNA, 19 nt, Artificial Sequence
  Synthetic
gacagaaauauucagcagu

SEQ ID NO: 24230 - RNA, 20 nt, Artificial Sequence
  Synthetic
agacagaaauauucagcagu

SEQ ID NO: 24231 - RNA, 21 nt, Artificial Sequence
  Synthetic
gagacagaaauauucagcagu

SEQ ID NO: 24232 - RNA, 22 nt, Artificial Sequence
  Synthetic
agagacagaaauauucagcagu

SEQ ID NO: 24233 - RNA, 23 nt, Artificial Sequence
  Synthetic
gagagacagaaauauucagcagu

SEQ ID NO: 24234 - RNA, 24 nt, Artificial Sequence
  Synthetic
ggagagacagaaauauucagcagu

SEQ ID NO: 24235 - RNA, 18 nt, Artificial Sequence
  Synthetic
aaaguuguccaagauagu

SEQ ID NO: 24236 - RNA, 19 nt, Artificial Sequence
  Synthetic
gaaaguuguccaagauagu

SEQ ID NO: 24237 - RNA, 21 nt, Artificial Sequence
  Synthetic
uggaaaguuguccaagauagu

SEQ ID NO: 24238 - RNA, 22 nt, Artificial Sequence
  Synthetic
auggaaaguuguccaagauagu

SEQ ID NO: 24239 - RNA, 23 nt, Artificial Sequence
  Synthetic
uauggaaaguuguccaagauagu

SEQ ID NO: 24240 - RNA, 24 nt, Artificial Sequence
  Synthetic
auauggaaaguuguccaagauagu

SEQ ID NO: 24241 - RNA, 18 nt, Artificial Sequence
  Synthetic
cuuuaucaacaugaaggu

SEQ ID NO: 24242 - RNA, 19 nt, Artificial Sequence
  Synthetic
ccuuuaucaacaugaaggu

SEQ ID NO: 24243 - RNA, 20 nt, Artificial Sequence
  Synthetic
cccuuuaucaacaugaaggu

SEQ ID NO: 24244 - RNA, 21 nt, Artificial Sequence
  Synthetic
acccuuuaucaacaugaaggu

SEQ ID NO: 24245 - RNA, 22 nt, Artificial Sequence
  Synthetic
gacccuuuaucaacaugaaggu

SEQ ID NO: 24246 - RNA, 23 nt, Artificial Sequence
  Synthetic
ugacccuuuaucaacaugaaggu

SEQ ID NO: 24247 - RNA, 24 nt, Artificial Sequence
  Synthetic
uugacccuuuaucaacaugaaggu

SEQ ID NO: 24248 - RNA, 18 nt, Artificial Sequence
  Synthetic
ugagggucucucuaaggu

SEQ ID NO: 24249 - RNA, 19 nt, Artificial Sequence
  Synthetic
gugagggucucucuaaggu

SEQ ID NO: 24250 - RNA, 20 nt, Artificial Sequence
  Synthetic
ggugagggucucucuaaggu

SEQ ID NO: 24251 - RNA, 21 nt, Artificial Sequence
  Synthetic
gggugagggucucucuaaggu

SEQ ID NO: 24252 - RNA, 22 nt, Artificial Sequence
  Synthetic
ggggugagggucucucuaaggu

SEQ ID NO: 24253 - RNA, 23 nt, Artificial Sequence
  Synthetic
aggggugagggucucucuaaggu

SEQ ID NO: 24254 - RNA, 24 nt, Artificial Sequence
  Synthetic
aaggggugagggucucucuaaggu

SEQ ID NO: 24255 - RNA, 18 nt, Artificial Sequence
  Synthetic
uuacauaaaaagagaggu

SEQ ID NO: 24256 - RNA, 19 nt, Artificial Sequence
  Synthetic
guuacauaaaaagagaggu

SEQ ID NO: 24257 - RNA, 21 nt, Artificial Sequence
  Synthetic
uuguuacauaaaaagagaggu

SEQ ID NO: 24258 - RNA, 22 nt, Artificial Sequence
  Synthetic
auuguuacauaaaaagagaggu

SEQ ID NO: 24259 - RNA, 23 nt, Artificial Sequence
  Synthetic
uauuguuacauaaaaagagaggu

SEQ ID NO: 24260 - RNA, 24 nt, Artificial Sequence
  Synthetic
auauuguuacauaaaaagagaggu

SEQ ID NO: 24261 - RNA, 18 nt, Artificial Sequence
  Synthetic
gcgggcggaucacgaggu

SEQ ID NO: 24262 - RNA, 19 nt, Artificial Sequence
  Synthetic
ggcgggcggaucacgaggu

SEQ ID NO: 24263 - RNA, 20 nt, Artificial Sequence
  Synthetic
aggcgggcggaucacgaggu

SEQ ID NO: 24264 - RNA, 21 nt, Artificial Sequence
  Synthetic
gaggcgggcggaucacgaggu

SEQ ID NO: 24265 - RNA, 22 nt, Artificial Sequence
  Synthetic
cgaggcgggcggaucacgaggu

SEQ ID NO: 24266 - RNA, 23 nt, Artificial Sequence
  Synthetic
ccgaggcgggcggaucacgaggu

SEQ ID NO: 24267 - RNA, 24 nt, Artificial Sequence
  Synthetic
gccgaggcgggcggaucacgaggu

SEQ ID NO: 24268 - RNA, 18 nt, Artificial Sequence
  Synthetic
uauauucuuuuauguggu

SEQ ID NO: 24269 - RNA, 19 nt, Artificial Sequence
  Synthetic
auauauucuuuuauguggu

SEQ ID NO: 24270 - RNA, 20 nt, Artificial Sequence
  Synthetic
aauauauucuuuuauguggu

SEQ ID NO: 24271 - RNA, 21 nt, Artificial Sequence
  Synthetic
gaauauauucuuuuauguggu

SEQ ID NO: 24272 - RNA, 22 nt, Artificial Sequence
  Synthetic
cgaauauauucuuuuauguggu

SEQ ID NO: 24273 - RNA, 23 nt, Artificial Sequence
  Synthetic
acgaauauauucuuuuauguggu

SEQ ID NO: 24274 - RNA, 24 nt, Artificial Sequence
  Synthetic
cacgaauauauucuuuuauguggu

SEQ ID NO: 24275 - RNA, 18 nt, Artificial Sequence
  Synthetic
aaaagcuguuucguaugu

SEQ ID NO: 24276 - RNA, 19 nt, Artificial Sequence
  Synthetic
uaaaagcuguuucguaugu

SEQ ID NO: 24277 - RNA, 21 nt, Artificial Sequence
  Synthetic
uuuaaaagcuguuucguaugu

SEQ ID NO: 24278 - RNA, 22 nt, Artificial Sequence
  Synthetic
uuuuaaaagcuguuucguaugu

SEQ ID NO: 24279 - RNA, 23 nt, Artificial Sequence
  Synthetic
guuuuaaaagcuguuucguaugu

SEQ ID NO: 24280 - RNA, 24 nt, Artificial Sequence
  Synthetic
uguuuuaaaagcuguuucguaugu

SEQ ID NO: 24281 - RNA, 18 nt, Artificial Sequence
  Synthetic
aucuguuaguaaugcugu

SEQ ID NO: 24282 - RNA, 19 nt, Artificial Sequence
  Synthetic
caucuguuaguaaugcugu

SEQ ID NO: 24283 - RNA, 21 nt, Artificial Sequence
  Synthetic
aucaucuguuaguaaugcugu

SEQ ID NO: 24284 - RNA, 22 nt, Artificial Sequence
  Synthetic
uaucaucuguuaguaaugcugu

SEQ ID NO: 24285 - RNA, 23 nt, Artificial Sequence
  Synthetic
auaucaucuguuaguaaugcugu

SEQ ID NO: 24286 - RNA, 24 nt, Artificial Sequence
  Synthetic
aauaucaucuguuaguaaugcugu

SEQ ID NO: 24287 - RNA, 18 nt, Artificial Sequence
  Synthetic
auagagacaagguggugu

SEQ ID NO: 24288 - RNA, 19 nt, Artificial Sequence
  Synthetic
aauagagacaagguggugu

SEQ ID NO: 24289 - RNA, 20 nt, Artificial Sequence
  Synthetic
uaauagagacaagguggugu

SEQ ID NO: 24290 - RNA, 21 nt, Artificial Sequence
  Synthetic
auaauagagacaagguggugu

SEQ ID NO: 24291 - RNA, 22 nt, Artificial Sequence
  Synthetic
aauaauagagacaagguggugu

SEQ ID NO: 24292 - RNA, 23 nt, Artificial Sequence
  Synthetic
caauaauagagacaagguggugu

SEQ ID NO: 24293 - RNA, 24 nt, Artificial Sequence
  Synthetic
ucaauaauagagacaagguggugu

SEQ ID NO: 24294 - RNA, 18 nt, Artificial Sequence
  Synthetic
gaaagaaaauguuuuugu

SEQ ID NO: 24295 - RNA, 19 nt, Artificial Sequence
  Synthetic
agaaagaaaauguuuuugu

SEQ ID NO: 24296 - RNA, 20 nt, Artificial Sequence
  Synthetic
aagaaagaaaauguuuuugu

SEQ ID NO: 24297 - RNA, 21 nt, Artificial Sequence
  Synthetic
uaagaaagaaaauguuuuugu

SEQ ID NO: 24298 - RNA, 22 nt, Artificial Sequence
  Synthetic
uuaagaaagaaaauguuuuugu

SEQ ID NO: 24299 - RNA, 23 nt, Artificial Sequence
  Synthetic
uuuaagaaagaaaauguuuuugu

SEQ ID NO: 24300 - RNA, 24 nt, Artificial Sequence
  Synthetic
uuuuaagaaagaaaauguuuuugu

SEQ ID NO: 24301 - RNA, 18 nt, Artificial Sequence
  Synthetic
uggcuuaacccaucuauu

SEQ ID NO: 24302 - RNA, 19 nt, Artificial Sequence
  Synthetic
uuggcuuaacccaucuauu

SEQ ID NO: 24303 - RNA, 20 nt, Artificial Sequence
  Synthetic
guuggcuuaacccaucuauu

SEQ ID NO: 24304 - RNA, 21 nt, Artificial Sequence
  Synthetic
aguuggcuuaacccaucuauu

SEQ ID NO: 24305 - RNA, 22 nt, Artificial Sequence
  Synthetic
caguuggcuuaacccaucuauu

SEQ ID NO: 24306 - RNA, 23 nt, Artificial Sequence
  Synthetic
ucaguuggcuuaacccaucuauu

SEQ ID NO: 24307 - RNA, 24 nt, Artificial Sequence
  Synthetic
uucaguuggcuuaacccaucuauu

SEQ ID NO: 24308 - RNA, 18 nt, Artificial Sequence
  Synthetic
auaauucuagaaaguauu

SEQ ID NO: 24309 - RNA, 19 nt, Artificial Sequence
  Synthetic
uauaauucuagaaaguauu

SEQ ID NO: 24310 - RNA, 20 nt, Artificial Sequence
  Synthetic
guauaauucuagaaaguauu

SEQ ID NO: 24311 - RNA, 21 nt, Artificial Sequence
  Synthetic
gguauaauucuagaaaguauu

SEQ ID NO: 24312 - RNA, 22 nt, Artificial Sequence
  Synthetic
cgguauaauucuagaaaguauu

SEQ ID NO: 24313 - RNA, 23 nt, Artificial Sequence
  Synthetic
ucgguauaauucuagaaaguauu

SEQ ID NO: 24314 - RNA, 24 nt, Artificial Sequence
  Synthetic
uucgguauaauucuagaaaguauu

SEQ ID NO: 24315 - RNA, 18 nt, Artificial Sequence
  Synthetic
uuuauuuauuuauuuauu

SEQ ID NO: 24316 - RNA, 19 nt, Artificial Sequence
  Synthetic
auuuauuuauuuauuuauu

SEQ ID NO: 24317 - RNA, 20 nt, Artificial Sequence
  Synthetic
uauuuauuuauuuauuuauu

SEQ ID NO: 24318 - RNA, 21 nt, Artificial Sequence
  Synthetic
uuauuuauuuauuuauuuauu

SEQ ID NO: 24319 - RNA, 22 nt, Artificial Sequence
  Synthetic
uuuauuuauuuauuuauuuauu

SEQ ID NO: 24320 - RNA, 23 nt, Artificial Sequence
  Synthetic
auuuauuuauuuauuuauuuauu

SEQ ID NO: 24321 - RNA, 24 nt, Artificial Sequence
  Synthetic
uauuuauuuauuuauuuauuuauu

SEQ ID NO: 24322 - RNA, 18 nt, Artificial Sequence
  Synthetic
uuugcugauugcuuuauu

SEQ ID NO: 24323 - RNA, 19 nt, Artificial Sequence
  Synthetic
auuugcugauugcuuuauu

SEQ ID NO: 24324 - RNA, 20 nt, Artificial Sequence
  Synthetic
aauuugcugauugcuuuauu

SEQ ID NO: 24325 - RNA, 21 nt, Artificial Sequence
  Synthetic
aaauuugcugauugcuuuauu

SEQ ID NO: 24326 - RNA, 22 nt, Artificial Sequence
  Synthetic
gaaauuugcugauugcuuuauu

SEQ ID NO: 24327 - RNA, 23 nt, Artificial Sequence
  Synthetic
ggaaauuugcugauugcuuuauu

SEQ ID NO: 24328 - RNA, 24 nt, Artificial Sequence
  Synthetic
aggaaauuugcugauugcuuuauu

SEQ ID NO: 24329 - RNA, 18 nt, Artificial Sequence
  Synthetic
ccuguaaucccaacacuu

SEQ ID NO: 24330 - RNA, 19 nt, Artificial Sequence
  Synthetic
gccuguaaucccaacacuu

SEQ ID NO: 24331 - RNA, 21 nt, Artificial Sequence
  Synthetic
augccuguaaucccaacacuu

SEQ ID NO: 24332 - RNA, 22 nt, Artificial Sequence
  Synthetic
caugccuguaaucccaacacuu

SEQ ID NO: 24333 - RNA, 23 nt, Artificial Sequence
  Synthetic
ucaugccuguaaucccaacacuu

SEQ ID NO: 24334 - RNA, 24 nt, Artificial Sequence
  Synthetic
cucaugccuguaaucccaacacuu

SEQ ID NO: 24335 - RNA, 18 nt, Artificial Sequence
  Synthetic
ccuauaaacccagcacuu

SEQ ID NO: 24336 - RNA, 19 nt, Artificial Sequence
  Synthetic
gccuauaaacccagcacuu

SEQ ID NO: 24337 - RNA, 21 nt, Artificial Sequence
  Synthetic
augccuauaaacccagcacuu

SEQ ID NO: 24338 - RNA, 22 nt, Artificial Sequence
  Synthetic
caugccuauaaacccagcacuu

SEQ ID NO: 24339 - RNA, 23 nt, Artificial Sequence
  Synthetic
ucaugccuauaaacccagcacuu

SEQ ID NO: 24340 - RNA, 24 nt, Artificial Sequence
  Synthetic
cucaugccuauaaacccagcacuu

SEQ ID NO: 24341 - RNA, 18 nt, Artificial Sequence
  Synthetic
ccuguaaucccagcacuu

SEQ ID NO: 24342 - RNA, 19 nt, Artificial Sequence
  Synthetic
gccuguaaucccagcacuu

SEQ ID NO: 24343 - RNA, 21 nt, Artificial Sequence
  Synthetic
acgccuguaaucccagcacuu

SEQ ID NO: 24344 - RNA, 22 nt, Artificial Sequence
  Synthetic
cacgccuguaaucccagcacuu

SEQ ID NO: 24345 - RNA, 23 nt, Artificial Sequence
  Synthetic
ucacgccuguaaucccagcacuu

SEQ ID NO: 24346 - RNA, 24 nt, Artificial Sequence
  Synthetic
cucacgccuguaaucccagcacuu

SEQ ID NO: 24347 - RNA, 18 nt, Artificial Sequence
  Synthetic
gaaccauuuuauagacuu

SEQ ID NO: 24348 - RNA, 19 nt, Artificial Sequence
  Synthetic
ggaaccauuuuauagacuu

SEQ ID NO: 24349 - RNA, 20 nt, Artificial Sequence
  Synthetic
aggaaccauuuuauagacuu

SEQ ID NO: 24350 - RNA, 21 nt, Artificial Sequence
  Synthetic
aaggaaccauuuuauagacuu

SEQ ID NO: 24351 - RNA, 22 nt, Artificial Sequence
  Synthetic
caaggaaccauuuuauagacuu

SEQ ID NO: 24352 - RNA, 23 nt, Artificial Sequence
  Synthetic
acaaggaaccauuuuauagacuu

SEQ ID NO: 24353 - RNA, 24 nt, Artificial Sequence
  Synthetic
aacaaggaaccauuuuauagacuu

SEQ ID NO: 24354 - RNA, 18 nt, Artificial Sequence
  Synthetic
cuguagucccagcuacuu

SEQ ID NO: 24355 - RNA, 19 nt, Artificial Sequence
  Synthetic
ccuguagucccagcuacuu

SEQ ID NO: 24356 - RNA, 21 nt, Artificial Sequence
  Synthetic
cgccuguagucccagcuacuu

SEQ ID NO: 24357 - RNA, 22 nt, Artificial Sequence
  Synthetic
gcgccuguagucccagcuacuu

SEQ ID NO: 24358 - RNA, 23 nt, Artificial Sequence
  Synthetic
ggcgccuguagucccagcuacuu

SEQ ID NO: 24359 - RNA, 24 nt, Artificial Sequence
  Synthetic
gggcgccuguagucccagcuacuu

SEQ ID NO: 24360 - RNA, 21 nt, Artificial Sequence
  Synthetic
ugccuguagucccagcuacuu

SEQ ID NO: 24361 - RNA, 22 nt, Artificial Sequence
  Synthetic
gugccuguagucccagcuacuu

SEQ ID NO: 24362 - RNA, 23 nt, Artificial Sequence
  Synthetic
cgugccuguagucccagcuacuu

SEQ ID NO: 24363 - RNA, 24 nt, Artificial Sequence
  Synthetic
gcgugccuguagucccagcuacuu

SEQ ID NO: 24364 - RNA, 18 nt, Artificial Sequence
  Synthetic
aauuuauuucucacaguu

SEQ ID NO: 24365 - RNA, 19 nt, Artificial Sequence
  Synthetic
gaauuuauuucucacaguu

SEQ ID NO: 24366 - RNA, 20 nt, Artificial Sequence
  Synthetic
ggaauuuauuucucacaguu

SEQ ID NO: 24367 - RNA, 21 nt, Artificial Sequence
  Synthetic
aggaauuuauuucucacaguu

SEQ ID NO: 24368 - RNA, 22 nt, Artificial Sequence
  Synthetic
caggaauuuauuucucacaguu

SEQ ID NO: 24369 - RNA, 23 nt, Artificial Sequence
  Synthetic
acaggaauuuauuucucacaguu

SEQ ID NO: 24370 - RNA, 24 nt, Artificial Sequence
  Synthetic
aacaggaauuuauuucucacaguu

SEQ ID NO: 24371 - RNA, 18 nt, Artificial Sequence
  Synthetic
cuugacaucaguuggguu

SEQ ID NO: 24372 - RNA, 19 nt, Artificial Sequence
  Synthetic
gcuugacaucaguuggguu

SEQ ID NO: 24373 - RNA, 20 nt, Artificial Sequence
  Synthetic
ugcuugacaucaguuggguu

SEQ ID NO: 24374 - RNA, 21 nt, Artificial Sequence
  Synthetic
cugcuugacaucaguuggguu

SEQ ID NO: 24375 - RNA, 22 nt, Artificial Sequence
  Synthetic
ucugcuugacaucaguuggguu

SEQ ID NO: 24376 - RNA, 23 nt, Artificial Sequence
  Synthetic
uucugcuugacaucaguuggguu

SEQ ID NO: 24377 - RNA, 24 nt, Artificial Sequence
  Synthetic
cuucugcuugacaucaguuggguu

SEQ ID NO: 24378 - RNA, 18 nt, Artificial Sequence
  Synthetic
aaaauauacccaaaauuu

SEQ ID NO: 24379 - RNA, 19 nt, Artificial Sequence
  Synthetic
uaaaauauacccaaaauuu

SEQ ID NO: 24380 - RNA, 20 nt, Artificial Sequence
  Synthetic
auaaaauauacccaaaauuu

SEQ ID NO: 24381 - RNA, 21 nt, Artificial Sequence
  Synthetic
uauaaaauauacccaaaauuu

SEQ ID NO: 24382 - RNA, 22 nt, Artificial Sequence
  Synthetic
auauaaaauauacccaaaauuu

SEQ ID NO: 24383 - RNA, 23 nt, Artificial Sequence
  Synthetic
aauauaaaauauacccaaaauuu

SEQ ID NO: 24384 - RNA, 24 nt, Artificial Sequence
  Synthetic
aaauauaaaauauacccaaaauuu

SEQ ID NO: 24385 - RNA, 18 nt, Artificial Sequence
  Synthetic
acgaauugguacaaauuu

SEQ ID NO: 24386 - RNA, 19 nt, Artificial Sequence
  Synthetic
uacgaauugguacaaauuu

SEQ ID NO: 24387 - RNA, 20 nt, Artificial Sequence
  Synthetic
guacgaauugguacaaauuu

SEQ ID NO: 24388 - RNA, 21 nt, Artificial Sequence
  Synthetic
aguacgaauugguacaaauuu

SEQ ID NO: 24389 - RNA, 22 nt, Artificial Sequence
  Synthetic
gaguacgaauugguacaaauuu

SEQ ID NO: 24390 - RNA, 23 nt, Artificial Sequence
  Synthetic
ugaguacgaauugguacaaauuu

SEQ ID NO: 24391 - RNA, 24 nt, Artificial Sequence
  Synthetic
augaguacgaauugguacaaauuu

SEQ ID NO: 24392 - RNA, 18 nt, Artificial Sequence
  Synthetic
cccuauuauucaacauuu

SEQ ID NO: 24393 - RNA, 19 nt, Artificial Sequence
  Synthetic
ccccuauuauucaacauuu

SEQ ID NO: 24394 - RNA, 20 nt, Artificial Sequence
  Synthetic
accccuauuauucaacauuu

SEQ ID NO: 24395 - RNA, 21 nt, Artificial Sequence
  Synthetic
aaccccuauuauucaacauuu

SEQ ID NO: 24396 - RNA, 22 nt, Artificial Sequence
  Synthetic
aaaccccuauuauucaacauuu

SEQ ID NO: 24397 - RNA, 23 nt, Artificial Sequence
  Synthetic
caaaccccuauuauucaacauuu

SEQ ID NO: 24398 - RNA, 24 nt, Artificial Sequence
  Synthetic
ucaaaccccuauuauucaacauuu

SEQ ID NO: 24399 - RNA, 18 nt, Artificial Sequence
  Synthetic
ucuauucaaaaaauauuu

SEQ ID NO: 24400 - RNA, 19 nt, Artificial Sequence
  Synthetic
aucuauucaaaaaauauuu

SEQ ID NO: 24401 - RNA, 20 nt, Artificial Sequence
  Synthetic
aaucuauucaaaaaauauuu

SEQ ID NO: 24402 - RNA, 21 nt, Artificial Sequence
  Synthetic
uaaucuauucaaaaaauauuu

SEQ ID NO: 24403 - RNA, 22 nt, Artificial Sequence
  Synthetic
cuaaucuauucaaaaaauauuu

SEQ ID NO: 24404 - RNA, 23 nt, Artificial Sequence
  Synthetic
gcuaaucuauucaaaaaauauuu

SEQ ID NO: 24405 - RNA, 24 nt, Artificial Sequence
  Synthetic
agcuaaucuauucaaaaaauauuu

SEQ ID NO: 24406 - RNA, 18 nt, Artificial Sequence
  Synthetic
cgaguuaucuccguauuu

SEQ ID NO: 24407 - RNA, 19 nt, Artificial Sequence
  Synthetic
acgaguuaucuccguauuu

SEQ ID NO: 24408 - RNA, 20 nt, Artificial Sequence
  Synthetic
cacgaguuaucuccguauuu

SEQ ID NO: 24409 - RNA, 21 nt, Artificial Sequence
  Synthetic
ucacgaguuaucuccguauuu

SEQ ID NO: 24410 - RNA, 22 nt, Artificial Sequence
  Synthetic
gucacgaguuaucuccguauuu

SEQ ID NO: 24411 - RNA, 23 nt, Artificial Sequence
  Synthetic
agucacgaguuaucuccguauuu

SEQ ID NO: 24412 - RNA, 24 nt, Artificial Sequence
  Synthetic
aagucacgaguuaucuccguauuu

SEQ ID NO: 24413 - RNA, 18 nt, Artificial Sequence
  Synthetic
cuguaaucccaacacuuu

SEQ ID NO: 24414 - RNA, 19 nt, Artificial Sequence
  Synthetic
ccuguaaucccaacacuuu

SEQ ID NO: 24415 - RNA, 21 nt, Artificial Sequence
  Synthetic
ugccuguaaucccaacacuuu

SEQ ID NO: 24416 - RNA, 22 nt, Artificial Sequence
  Synthetic
augccuguaaucccaacacuuu

SEQ ID NO: 24417 - RNA, 23 nt, Artificial Sequence
  Synthetic
caugccuguaaucccaacacuuu

SEQ ID NO: 24418 - RNA, 24 nt, Artificial Sequence
  Synthetic
ucaugccuguaaucccaacacuuu

SEQ ID NO: 24419 - RNA, 18 nt, Artificial Sequence
  Synthetic
cuauaaacccagcacuuu

SEQ ID NO: 24420 - RNA, 19 nt, Artificial Sequence
  Synthetic
ccuauaaacccagcacuuu

SEQ ID NO: 24421 - RNA, 21 nt, Artificial Sequence
  Synthetic
ugccuauaaacccagcacuuu

SEQ ID NO: 24422 - RNA, 22 nt, Artificial Sequence
  Synthetic
augccuauaaacccagcacuuu

SEQ ID NO: 24423 - RNA, 23 nt, Artificial Sequence
  Synthetic
caugccuauaaacccagcacuuu

SEQ ID NO: 24424 - RNA, 24 nt, Artificial Sequence
  Synthetic
ucaugccuauaaacccagcacuuu

SEQ ID NO: 24425 - RNA, 18 nt, Artificial Sequence
  Synthetic
cuguaaucccagcacuuu

SEQ ID NO: 24426 - RNA, 19 nt, Artificial Sequence
  Synthetic
ccuguaaucccagcacuuu

SEQ ID NO: 24427 - RNA, 21 nt, Artificial Sequence
  Synthetic
cgccuguaaucccagcacuuu

SEQ ID NO: 24428 - RNA, 22 nt, Artificial Sequence
  Synthetic
acgccuguaaucccagcacuuu

SEQ ID NO: 24429 - RNA, 23 nt, Artificial Sequence
  Synthetic
cacgccuguaaucccagcacuuu

SEQ ID NO: 24430 - RNA, 24 nt, Artificial Sequence
  Synthetic
ucacgccuguaaucccagcacuuu

SEQ ID NO: 24431 - RNA, 18 nt, Artificial Sequence
  Synthetic
ugauaaauaauugccuuu

SEQ ID NO: 24432 - RNA, 19 nt, Artificial Sequence
  Synthetic
uugauaaauaauugccuuu

SEQ ID NO: 24433 - RNA, 20 nt, Artificial Sequence
  Synthetic
auugauaaauaauugccuuu

SEQ ID NO: 24434 - RNA, 21 nt, Artificial Sequence
  Synthetic
uauugauaaauaauugccuuu

SEQ ID NO: 24435 - RNA, 22 nt, Artificial Sequence
  Synthetic
auauugauaaauaauugccuuu

SEQ ID NO: 24436 - RNA, 23 nt, Artificial Sequence
  Synthetic
gauauugauaaauaauugccuuu

SEQ ID NO: 24437 - RNA, 24 nt, Artificial Sequence
  Synthetic
agauauugauaaauaauugccuuu

SEQ ID NO: 24438 - RNA, 18 nt, Artificial Sequence
  Synthetic
aaauaagccuuagucuuu

SEQ ID NO: 24439 - RNA, 19 nt, Artificial Sequence
  Synthetic
gaaauaagccuuagucuuu

SEQ ID NO: 24440 - RNA, 20 nt, Artificial Sequence
  Synthetic
agaaauaagccuuagucuuu

SEQ ID NO: 24441 - RNA, 21 nt, Artificial Sequence
  Synthetic
gagaaauaagccuuagucuuu

SEQ ID NO: 24442 - RNA, 22 nt, Artificial Sequence
  Synthetic
agagaaauaagccuuagucuuu

SEQ ID NO: 24443 - RNA, 23 nt, Artificial Sequence
  Synthetic
cagagaaauaagccuuagucuuu

SEQ ID NO: 24444 - RNA, 24 nt, Artificial Sequence
  Synthetic
ccagagaaauaagccuuagucuuu

SEQ ID NO: 24445 - RNA, 18 nt, Artificial Sequence
  Synthetic
agaaaauuuguuuucuuu

SEQ ID NO: 24446 - RNA, 19 nt, Artificial Sequence
  Synthetic
aagaaaauuuguuuucuuu

SEQ ID NO: 24447 - RNA, 20 nt, Artificial Sequence
  Synthetic
aaagaaaauuuguuuucuuu

SEQ ID NO: 24448 - RNA, 21 nt, Artificial Sequence
  Synthetic
caaagaaaauuuguuuucuuu

SEQ ID NO: 24449 - RNA, 22 nt, Artificial Sequence
  Synthetic
acaaagaaaauuuguuuucuuu

SEQ ID NO: 24450 - RNA, 23 nt, Artificial Sequence
  Synthetic
aacaaagaaaauuuguuuucuuu

SEQ ID NO: 24451 - RNA, 24 nt, Artificial Sequence
  Synthetic
aaacaaagaaaauuuguuuucuuu

SEQ ID NO: 24452 - RNA, 18 nt, Artificial Sequence
  Synthetic
gaaaaauaauaacauuuu

SEQ ID NO: 24453 - RNA, 19 nt, Artificial Sequence
  Synthetic
agaaaaauaauaacauuuu

SEQ ID NO: 24454 - RNA, 20 nt, Artificial Sequence
  Synthetic
aagaaaaauaauaacauuuu

SEQ ID NO: 24455 - RNA, 21 nt, Artificial Sequence
  Synthetic
aaagaaaaauaauaacauuuu

SEQ ID NO: 24456 - RNA, 22 nt, Artificial Sequence
  Synthetic
aaaagaaaaauaauaacauuuu

SEQ ID NO: 24457 - RNA, 23 nt, Artificial Sequence
  Synthetic
uaaaagaaaaauaauaacauuuu

SEQ ID NO: 24458 - RNA, 24 nt, Artificial Sequence
  Synthetic
auaaaagaaaaauaauaacauuuu

SEQ ID NO: 24459 - RNA, 18 nt, Artificial Sequence
  Synthetic
auacauacauaugauuuu

SEQ ID NO: 24460 - RNA, 19 nt, Artificial Sequence
  Synthetic
uauacauacauaugauuuu

SEQ ID NO: 24461 - RNA, 20 nt, Artificial Sequence
  Synthetic
auauacauacauaugauuuu

SEQ ID NO: 24462 - RNA, 21 nt, Artificial Sequence
  Synthetic
uauauacauacauaugauuuu

SEQ ID NO: 24463 - RNA, 22 nt, Artificial Sequence
  Synthetic
auauauacauacauaugauuuu

SEQ ID NO: 24464 - RNA, 23 nt, Artificial Sequence
  Synthetic
cauauauacauacauaugauuuu

SEQ ID NO: 24465 - RNA, 24 nt, Artificial Sequence
  Synthetic
acauauauacauacauaugauuuu

SEQ ID NO: 24466 - RNA, 18 nt, Artificial Sequence
  Synthetic
caccaauuuuuuuuuuuu

SEQ ID NO: 24467 - RNA, 19 nt, Artificial Sequence
  Synthetic
acaccaauuuuuuuuuuuu

SEQ ID NO: 24468 - RNA, 20 nt, Artificial Sequence
  Synthetic
aacaccaauuuuuuuuuuuu

SEQ ID NO: 24469 - RNA, 21 nt, Artificial Sequence
  Synthetic
aaacaccaauuuuuuuuuuuu

SEQ ID NO: 24470 - RNA, 22 nt, Artificial Sequence
  Synthetic
caaacaccaauuuuuuuuuuuu

SEQ ID NO: 24471 - RNA, 23 nt, Artificial Sequence
  Synthetic
gcaaacaccaauuuuuuuuuuuu

SEQ ID NO: 24472 - RNA, 24 nt, Artificial Sequence
  Synthetic
ugcaaacaccaauuuuuuuuuuuu

SEQ ID NO: 24473 - RNA, 18 nt, Artificial Sequence
  Synthetic
uaaaaauguuaaugaaaa

SEQ ID NO: 24474 - RNA, 19 nt, Artificial Sequence
  Synthetic
guaaaaauguuaaugaaaa

SEQ ID NO: 24475 - RNA, 20 nt, Artificial Sequence
  Synthetic
gguaaaaauguuaaugaaaa

SEQ ID NO: 24476 - RNA, 21 nt, Artificial Sequence
  Synthetic
agguaaaaauguuaaugaaaa

SEQ ID NO: 24477 - RNA, 22 nt, Artificial Sequence
  Synthetic
uagguaaaaauguuaaugaaaa

SEQ ID NO: 24478 - RNA, 23 nt, Artificial Sequence
  Synthetic
guagguaaaaauguuaaugaaaa

SEQ ID NO: 24479 - RNA, 24 nt, Artificial Sequence
  Synthetic
uguagguaaaaauguuaaugaaaa

SEQ ID NO: 24480 - RNA, 18 nt, Artificial Sequence
  Synthetic
auuuauuaaaauuuaaaa

SEQ ID NO: 24481 - RNA, 19 nt, Artificial Sequence
  Synthetic
uauuuauuaaaauuuaaaa

SEQ ID NO: 24482 - RNA, 20 nt, Artificial Sequence
  Synthetic
uuauuuauuaaaauuuaaaa

SEQ ID NO: 24483 - RNA, 21 nt, Artificial Sequence
  Synthetic
auuauuuauuaaaauuuaaaa

SEQ ID NO: 24484 - RNA, 22 nt, Artificial Sequence
  Synthetic
uauuauuuauuaaaauuuaaaa

SEQ ID NO: 24485 - RNA, 23 nt, Artificial Sequence
  Synthetic
auauuauuuauuaaaauuuaaaa

SEQ ID NO: 24486 - RNA, 24 nt, Artificial Sequence
  Synthetic
gauauuauuuauuaaaauuuaaaa

SEQ ID NO: 24487 - RNA, 18 nt, Artificial Sequence
  Synthetic
cgaauaaucuaagacaaa

SEQ ID NO: 24488 - RNA, 19 nt, Artificial Sequence
  Synthetic
ccgaauaaucuaagacaaa

SEQ ID NO: 24489 - RNA, 20 nt, Artificial Sequence
  Synthetic
accgaauaaucuaagacaaa

SEQ ID NO: 24490 - RNA, 21 nt, Artificial Sequence
  Synthetic
uaccgaauaaucuaagacaaa

SEQ ID NO: 24491 - RNA, 22 nt, Artificial Sequence
  Synthetic
auaccgaauaaucuaagacaaa

SEQ ID NO: 24492 - RNA, 23 nt, Artificial Sequence
  Synthetic
uauaccgaauaaucuaagacaaa

SEQ ID NO: 24493 - RNA, 24 nt, Artificial Sequence
  Synthetic
uuauaccgaauaaucuaagacaaa

SEQ ID NO: 24494 - RNA, 18 nt, Artificial Sequence
  Synthetic
gccuauuugacauccaaa

SEQ ID NO: 24495 - RNA, 19 nt, Artificial Sequence
  Synthetic
ugccuauuugacauccaaa

SEQ ID NO: 24496 - RNA, 20 nt, Artificial Sequence
  Synthetic
augccuauuugacauccaaa

SEQ ID NO: 24497 - RNA, 21 nt, Artificial Sequence
  Synthetic
aaugccuauuugacauccaaa

SEQ ID NO: 24498 - RNA, 22 nt, Artificial Sequence
  Synthetic
aaaugccuauuugacauccaaa

SEQ ID NO: 24499 - RNA, 23 nt, Artificial Sequence
  Synthetic
gaaaugccuauuugacauccaaa

SEQ ID NO: 24500 - RNA, 24 nt, Artificial Sequence
  Synthetic
ugaaaugccuauuugacauccaaa

SEQ ID NO: 24501 - RNA, 18 nt, Artificial Sequence
  Synthetic
gacaaacagaaaaagaaa

SEQ ID NO: 24502 - RNA, 19 nt, Artificial Sequence
  Synthetic
agacaaacagaaaaagaaa

SEQ ID NO: 24503 - RNA, 20 nt, Artificial Sequence
  Synthetic
aagacaaacagaaaaagaaa

SEQ ID NO: 24504 - RNA, 21 nt, Artificial Sequence
  Synthetic
uaagacaaacagaaaaagaaa

SEQ ID NO: 24505 - RNA, 22 nt, Artificial Sequence
  Synthetic
cuaagacaaacagaaaaagaaa

SEQ ID NO: 24506 - RNA, 23 nt, Artificial Sequence
  Synthetic
ucuaagacaaacagaaaaagaaa

SEQ ID NO: 24507 - RNA, 24 nt, Artificial Sequence
  Synthetic
aucuaagacaaacagaaaaagaaa

SEQ ID NO: 24508 - RNA, 18 nt, Artificial Sequence
  Synthetic
aucuaagacaaacagaaa

SEQ ID NO: 24509 - RNA, 19 nt, Artificial Sequence
  Synthetic
aaucuaagacaaacagaaa

SEQ ID NO: 24510 - RNA, 20 nt, Artificial Sequence
  Synthetic
uaaucuaagacaaacagaaa

SEQ ID NO: 24511 - RNA, 21 nt, Artificial Sequence
  Synthetic
auaaucuaagacaaacagaaa

SEQ ID NO: 24512 - RNA, 22 nt, Artificial Sequence
  Synthetic
aauaaucuaagacaaacagaaa

SEQ ID NO: 24513 - RNA, 23 nt, Artificial Sequence
  Synthetic
gaauaaucuaagacaaacagaaa

SEQ ID NO: 24514 - RNA, 24 nt, Artificial Sequence
  Synthetic
cgaauaaucuaagacaaacagaaa

SEQ ID NO: 24515 - RNA, 18 nt, Artificial Sequence
  Synthetic
ggcaccauucacaguaaa

SEQ ID NO: 24516 - RNA, 19 nt, Artificial Sequence
  Synthetic
uggcaccauucacaguaaa

SEQ ID NO: 24517 - RNA, 20 nt, Artificial Sequence
  Synthetic
cuggcaccauucacaguaaa

SEQ ID NO: 24518 - RNA, 21 nt, Artificial Sequence
  Synthetic
ccuggcaccauucacaguaaa

SEQ ID NO: 24519 - RNA, 22 nt, Artificial Sequence
  Synthetic
accuggcaccauucacaguaaa

SEQ ID NO: 24520 - RNA, 23 nt, Artificial Sequence
  Synthetic
uaccuggcaccauucacaguaaa

SEQ ID NO: 24521 - RNA, 24 nt, Artificial Sequence
  Synthetic
cuaccuggcaccauucacaguaaa

SEQ ID NO: 24522 - RNA, 18 nt, Artificial Sequence
  Synthetic
ccacuggagaguuuuaaa

SEQ ID NO: 24523 - RNA, 19 nt, Artificial Sequence
  Synthetic
gccacuggagaguuuuaaa

SEQ ID NO: 24524 - RNA, 20 nt, Artificial Sequence
  Synthetic
ggccacuggagaguuuuaaa

SEQ ID NO: 24525 - RNA, 21 nt, Artificial Sequence
  Synthetic
aggccacuggagaguuuuaaa

SEQ ID NO: 24526 - RNA, 22 nt, Artificial Sequence
  Synthetic
gaggccacuggagaguuuuaaa

SEQ ID NO: 24527 - RNA, 23 nt, Artificial Sequence
  Synthetic
agaggccacuggagaguuuuaaa

SEQ ID NO: 24528 - RNA, 24 nt, Artificial Sequence
  Synthetic
uagaggccacuggagaguuuuaaa

SEQ ID NO: 24529 - RNA, 18 nt, Artificial Sequence
  Synthetic
uacaaaaaacacaaacaa

SEQ ID NO: 24530 - RNA, 19 nt, Artificial Sequence
  Synthetic
cuacaaaaaacacaaacaa

SEQ ID NO: 24531 - RNA, 20 nt, Artificial Sequence
  Synthetic
ucuacaaaaaacacaaacaa

SEQ ID NO: 24532 - RNA, 21 nt, Artificial Sequence
  Synthetic
cucuacaaaaaacacaaacaa

SEQ ID NO: 24533 - RNA, 22 nt, Artificial Sequence
  Synthetic
ccucuacaaaaaacacaaacaa

SEQ ID NO: 24534 - RNA, 23 nt, Artificial Sequence
  Synthetic
accucuacaaaaaacacaaacaa

SEQ ID NO: 24535 - RNA, 24 nt, Artificial Sequence
  Synthetic
caccucuacaaaaaacacaaacaa

SEQ ID NO: 24536 - RNA, 18 nt, Artificial Sequence
  Synthetic
uaaagacuguuguaacaa

SEQ ID NO: 24537 - RNA, 19 nt, Artificial Sequence
  Synthetic
auaaagacuguuguaacaa

SEQ ID NO: 24538 - RNA, 20 nt, Artificial Sequence
  Synthetic
uauaaagacuguuguaacaa

SEQ ID NO: 24539 - RNA, 21 nt, Artificial Sequence
  Synthetic
guauaaagacuguuguaacaa

SEQ ID NO: 24540 - RNA, 22 nt, Artificial Sequence
  Synthetic
aguauaaagacuguuguaacaa

SEQ ID NO: 24541 - RNA, 23 nt, Artificial Sequence
  Synthetic
caguauaaagacuguuguaacaa

SEQ ID NO: 24542 - RNA, 24 nt, Artificial Sequence
  Synthetic
ccaguauaaagacuguuguaacaa

SEQ ID NO: 24543 - RNA, 18 nt, Artificial Sequence
  Synthetic
uauucuguagggagacaa

SEQ ID NO: 24544 - RNA, 19 nt, Artificial Sequence
  Synthetic
cuauucuguagggagacaa

SEQ ID NO: 24545 - RNA, 21 nt, Artificial Sequence
  Synthetic
ggcuauucuguagggagacaa

SEQ ID NO: 24546 - RNA, 22 nt, Artificial Sequence
  Synthetic
aggcuauucuguagggagacaa

SEQ ID NO: 24547 - RNA, 23 nt, Artificial Sequence
  Synthetic
uaggcuauucuguagggagacaa

SEQ ID NO: 24548 - RNA, 24 nt, Artificial Sequence
  Synthetic
uuaggcuauucuguagggagacaa

SEQ ID NO: 24549 - RNA, 18 nt, Artificial Sequence
  Synthetic
auagauggguuaagccaa

SEQ ID NO: 24550 - RNA, 19 nt, Artificial Sequence
  Synthetic
aauagauggguuaagccaa

SEQ ID NO: 24551 - RNA, 20 nt, Artificial Sequence
  Synthetic
uaauagauggguuaagccaa

SEQ ID NO: 24552 - RNA, 21 nt, Artificial Sequence
  Synthetic
uuaauagauggguuaagccaa

SEQ ID NO: 24553 - RNA, 22 nt, Artificial Sequence
  Synthetic
cuuaauagauggguuaagccaa

SEQ ID NO: 24554 - RNA, 23 nt, Artificial Sequence
  Synthetic
ucuuaauagauggguuaagccaa

SEQ ID NO: 24555 - RNA, 24 nt, Artificial Sequence
  Synthetic
cucuuaauagauggguuaagccaa

SEQ ID NO: 24556 - RNA, 18 nt, Artificial Sequence
  Synthetic
agaaagaaaaaacagcaa

SEQ ID NO: 24557 - RNA, 19 nt, Artificial Sequence
  Synthetic
uagaaagaaaaaacagcaa

SEQ ID NO: 24558 - RNA, 20 nt, Artificial Sequence
  Synthetic
uuagaaagaaaaaacagcaa

SEQ ID NO: 24559 - RNA, 21 nt, Artificial Sequence
  Synthetic
auuagaaagaaaaaacagcaa

SEQ ID NO: 24560 - RNA, 22 nt, Artificial Sequence
  Synthetic
gauuagaaagaaaaaacagcaa

SEQ ID NO: 24561 - RNA, 23 nt, Artificial Sequence
  Synthetic
agauuagaaagaaaaaacagcaa

SEQ ID NO: 24562 - RNA, 24 nt, Artificial Sequence
  Synthetic
uagauuagaaagaaaaaacagcaa

SEQ ID NO: 24563 - RNA, 18 nt, Artificial Sequence
  Synthetic
acuguuguaacaaaagaa

SEQ ID NO: 24564 - RNA, 19 nt, Artificial Sequence
  Synthetic
gacuguuguaacaaaagaa

SEQ ID NO: 24565 - RNA, 20 nt, Artificial Sequence
  Synthetic
agacuguuguaacaaaagaa

SEQ ID NO: 24566 - RNA, 21 nt, Artificial Sequence
  Synthetic
aagacuguuguaacaaaagaa

SEQ ID NO: 24567 - RNA, 22 nt, Artificial Sequence
  Synthetic
aaagacuguuguaacaaaagaa

SEQ ID NO: 24568 - RNA, 23 nt, Artificial Sequence
  Synthetic
uaaagacuguuguaacaaaagaa

SEQ ID NO: 24569 - RNA, 24 nt, Artificial Sequence
  Synthetic
auaaagacuguuguaacaaaagaa

SEQ ID NO: 24570 - RNA, 18 nt, Artificial Sequence
  Synthetic
gaaggaaaugaggaagaa

SEQ ID NO: 24571 - RNA, 19 nt, Artificial Sequence
  Synthetic
agaaggaaaugaggaagaa

SEQ ID NO: 24572 - RNA, 21 nt, Artificial Sequence
  Synthetic
aaagaaggaaaugaggaagaa

SEQ ID NO: 24573 - RNA, 22 nt, Artificial Sequence
  Synthetic
gaaagaaggaaaugaggaagaa

SEQ ID NO: 24574 - RNA, 23 nt, Artificial Sequence
  Synthetic
agaaagaaggaaaugaggaagaa

SEQ ID NO: 24575 - RNA, 24 nt, Artificial Sequence
  Synthetic
aagaaagaaggaaaugaggaagaa

SEQ ID NO: 24576 - RNA, 18 nt, Artificial Sequence
  Synthetic
aaagaggguugauaagaa

SEQ ID NO: 24577 - RNA, 19 nt, Artificial Sequence
  Synthetic
gaaagaggguugauaagaa

SEQ ID NO: 24578 - RNA, 20 nt, Artificial Sequence
  Synthetic
ggaaagaggguugauaagaa

SEQ ID NO: 24579 - RNA, 21 nt, Artificial Sequence
  Synthetic
aggaaagaggguugauaagaa

SEQ ID NO: 24580 - RNA, 22 nt, Artificial Sequence
  Synthetic
aaggaaagaggguugauaagaa

SEQ ID NO: 24581 - RNA, 23 nt, Artificial Sequence
  Synthetic
aaaggaaagaggguugauaagaa

SEQ ID NO: 24582 - RNA, 24 nt, Artificial Sequence
  Synthetic
uaaaggaaagaggguugauaagaa

SEQ ID NO: 24583 - RNA, 18 nt, Artificial Sequence
  Synthetic
aucaccugagccugagaa

SEQ ID NO: 24584 - RNA, 19 nt, Artificial Sequence
  Synthetic
gaucaccugagccugagaa

SEQ ID NO: 24585 - RNA, 20 nt, Artificial Sequence
  Synthetic
ggaucaccugagccugagaa

SEQ ID NO: 24586 - RNA, 21 nt, Artificial Sequence
  Synthetic
aggaucaccugagccugagaa

SEQ ID NO: 24587 - RNA, 22 nt, Artificial Sequence
  Synthetic
gaggaucaccugagccugagaa

SEQ ID NO: 24588 - RNA, 23 nt, Artificial Sequence
  Synthetic
ggaggaucaccugagccugagaa

SEQ ID NO: 24589 - RNA, 24 nt, Artificial Sequence
  Synthetic
gggaggaucaccugagccugagaa

SEQ ID NO: 24590 - RNA, 18 nt, Artificial Sequence
  Synthetic
uuuaaacacuucugagaa

SEQ ID NO: 24591 - RNA, 19 nt, Artificial Sequence
  Synthetic
auuuaaacacuucugagaa

SEQ ID NO: 24592 - RNA, 20 nt, Artificial Sequence
  Synthetic
uauuuaaacacuucugagaa

SEQ ID NO: 24593 - RNA, 21 nt, Artificial Sequence
  Synthetic
auauuuaaacacuucugagaa

SEQ ID NO: 24594 - RNA, 22 nt, Artificial Sequence
  Synthetic
aauauuuaaacacuucugagaa

SEQ ID NO: 24595 - RNA, 23 nt, Artificial Sequence
  Synthetic
gaauauuuaaacacuucugagaa

SEQ ID NO: 24596 - RNA, 24 nt, Artificial Sequence
  Synthetic
ggaauauuuaaacacuucugagaa

SEQ ID NO: 24597 - RNA, 18 nt, Artificial Sequence
  Synthetic
aaggaauuuuauauagaa

SEQ ID NO: 24598 - RNA, 19 nt, Artificial Sequence
  Synthetic
aaaggaauuuuauauagaa

SEQ ID NO: 24599 - RNA, 20 nt, Artificial Sequence
  Synthetic
caaaggaauuuuauauagaa

SEQ ID NO: 24600 - RNA, 21 nt, Artificial Sequence
  Synthetic
acaaaggaauuuuauauagaa

SEQ ID NO: 24601 - RNA, 22 nt, Artificial Sequence
  Synthetic
uacaaaggaauuuuauauagaa

SEQ ID NO: 24602 - RNA, 23 nt, Artificial Sequence
  Synthetic
guacaaaggaauuuuauauagaa

SEQ ID NO: 24603 - RNA, 24 nt, Artificial Sequence
  Synthetic
uguacaaaggaauuuuauauagaa

SEQ ID NO: 24604 - RNA, 18 nt, Artificial Sequence
  Synthetic
aagucuaguuucaaggaa

SEQ ID NO: 24605 - RNA, 19 nt, Artificial Sequence
  Synthetic
caagucuaguuucaaggaa

SEQ ID NO: 24606 - RNA, 20 nt, Artificial Sequence
  Synthetic
acaagucuaguuucaaggaa

SEQ ID NO: 24607 - RNA, 21 nt, Artificial Sequence
  Synthetic
uacaagucuaguuucaaggaa

SEQ ID NO: 24608 - RNA, 22 nt, Artificial Sequence
  Synthetic
guacaagucuaguuucaaggaa

SEQ ID NO: 24609 - RNA, 23 nt, Artificial Sequence
  Synthetic
uguacaagucuaguuucaaggaa

SEQ ID NO: 24610 - RNA, 24 nt, Artificial Sequence
  Synthetic
auguacaagucuaguuucaaggaa

SEQ ID NO: 24611 - RNA, 18 nt, Artificial Sequence
  Synthetic
gaaggaagaaagaaggaa

SEQ ID NO: 24612 - RNA, 19 nt, Artificial Sequence
  Synthetic
ggaaggaagaaagaaggaa

SEQ ID NO: 24613 - RNA, 20 nt, Artificial Sequence
  Synthetic
aggaaggaagaaagaaggaa

SEQ ID NO: 24614 - RNA, 21 nt, Artificial Sequence
  Synthetic
gaggaaggaagaaagaaggaa

SEQ ID NO: 24615 - RNA, 22 nt, Artificial Sequence
  Synthetic
agaggaaggaagaaagaaggaa

SEQ ID NO: 24616 - RNA, 23 nt, Artificial Sequence
  Synthetic
gagaggaaggaagaaagaaggaa

SEQ ID NO: 24617 - RNA, 24 nt, Artificial Sequence
  Synthetic
agagaggaaggaagaaagaaggaa

SEQ ID NO: 24618 - RNA, 18 nt, Artificial Sequence
  Synthetic
uuuuaguaguauuaggaa

SEQ ID NO: 24619 - RNA, 19 nt, Artificial Sequence
  Synthetic
cuuuuaguaguauuaggaa

SEQ ID NO: 24620 - RNA, 21 nt, Artificial Sequence
  Synthetic
gccuuuuaguaguauuaggaa

SEQ ID NO: 24621 - RNA, 22 nt, Artificial Sequence
  Synthetic
ugccuuuuaguaguauuaggaa

SEQ ID NO: 24622 - RNA, 23 nt, Artificial Sequence
  Synthetic
cugccuuuuaguaguauuaggaa

SEQ ID NO: 24623 - RNA, 24 nt, Artificial Sequence
  Synthetic
gcugccuuuuaguaguauuaggaa

SEQ ID NO: 24624 - RNA, 18 nt, Artificial Sequence
  Synthetic
ugaaauuagaaagaauaa

SEQ ID NO: 24625 - RNA, 19 nt, Artificial Sequence
  Synthetic
augaaauuagaaagaauaa

SEQ ID NO: 24626 - RNA, 20 nt, Artificial Sequence
  Synthetic
aaugaaauuagaaagaauaa

SEQ ID NO: 24627 - RNA, 21 nt, Artificial Sequence
  Synthetic
gaaugaaauuagaaagaauaa

SEQ ID NO: 24628 - RNA, 22 nt, Artificial Sequence
  Synthetic
agaaugaaauuagaaagaauaa

SEQ ID NO: 24629 - RNA, 23 nt, Artificial Sequence
  Synthetic
cagaaugaaauuagaaagaauaa

SEQ ID NO: 24630 - RNA, 24 nt, Artificial Sequence
  Synthetic
ccagaaugaaauuagaaagaauaa

SEQ ID NO: 24631 - RNA, 18 nt, Artificial Sequence
  Synthetic
aaauauaagauugaauaa

SEQ ID NO: 24632 - RNA, 19 nt, Artificial Sequence
  Synthetic
aaaauauaagauugaauaa

SEQ ID NO: 24633 - RNA, 20 nt, Artificial Sequence
  Synthetic
uaaaauauaagauugaauaa

SEQ ID NO: 24634 - RNA, 21 nt, Artificial Sequence
  Synthetic
cuaaaauauaagauugaauaa

SEQ ID NO: 24635 - RNA, 22 nt, Artificial Sequence
  Synthetic
gcuaaaauauaagauugaauaa

SEQ ID NO: 24636 - RNA, 23 nt, Artificial Sequence
  Synthetic
agcuaaaauauaagauugaauaa

SEQ ID NO: 24637 - RNA, 24 nt, Artificial Sequence
  Synthetic
uagcuaaaauauaagauugaauaa

SEQ ID NO: 24638 - RNA, 18 nt, Artificial Sequence
  Synthetic
cccauaaauguugaauaa

SEQ ID NO: 24639 - RNA, 19 nt, Artificial Sequence
  Synthetic
ccccauaaauguugaauaa

SEQ ID NO: 24640 - RNA, 20 nt, Artificial Sequence
  Synthetic
gccccauaaauguugaauaa

SEQ ID NO: 24641 - RNA, 21 nt, Artificial Sequence
  Synthetic
agccccauaaauguugaauaa

SEQ ID NO: 24642 - RNA, 22 nt, Artificial Sequence
  Synthetic
gagccccauaaauguugaauaa

SEQ ID NO: 24643 - RNA, 23 nt, Artificial Sequence
  Synthetic
ggagccccauaaauguugaauaa

SEQ ID NO: 24644 - RNA, 24 nt, Artificial Sequence
  Synthetic
gggagccccauaaauguugaauaa

SEQ ID NO: 24645 - RNA, 18 nt, Artificial Sequence
  Synthetic
agcuuauucuuguaauaa

SEQ ID NO: 24646 - RNA, 19 nt, Artificial Sequence
  Synthetic
uagcuuauucuuguaauaa

SEQ ID NO: 24647 - RNA, 20 nt, Artificial Sequence
  Synthetic
uuagcuuauucuuguaauaa

SEQ ID NO: 24648 - RNA, 21 nt, Artificial Sequence
  Synthetic
uuuagcuuauucuuguaauaa

SEQ ID NO: 24649 - RNA, 22 nt, Artificial Sequence
  Synthetic
uuuuagcuuauucuuguaauaa

SEQ ID NO: 24650 - RNA, 23 nt, Artificial Sequence
  Synthetic
guuuuagcuuauucuuguaauaa

SEQ ID NO: 24651 - RNA, 24 nt, Artificial Sequence
  Synthetic
aguuuuagcuuauucuuguaauaa

SEQ ID NO: 24652 - RNA, 18 nt, Artificial Sequence
  Synthetic
cguuuacuagaaagauaa

SEQ ID NO: 24653 - RNA, 19 nt, Artificial Sequence
  Synthetic
ccguuuacuagaaagauaa

SEQ ID NO: 24654 - RNA, 21 nt, Artificial Sequence
  Synthetic
ugccguuuacuagaaagauaa

SEQ ID NO: 24655 - RNA, 22 nt, Artificial Sequence
  Synthetic
gugccguuuacuagaaagauaa

SEQ ID NO: 24656 - RNA, 23 nt, Artificial Sequence
  Synthetic
ugugccguuuacuagaaagauaa

SEQ ID NO: 24657 - RNA, 24 nt, Artificial Sequence
  Synthetic
augugccguuuacuagaaagauaa

SEQ ID NO: 24658 - RNA, 18 nt, Artificial Sequence
  Synthetic
ccugcaauuucgagauaa

SEQ ID NO: 24659 - RNA, 19 nt, Artificial Sequence
  Synthetic
gccugcaauuucgagauaa

SEQ ID NO: 24660 - RNA, 20 nt, Artificial Sequence
  Synthetic
ugccugcaauuucgagauaa

SEQ ID NO: 24661 - RNA, 21 nt, Artificial Sequence
  Synthetic
uugccugcaauuucgagauaa

SEQ ID NO: 24662 - RNA, 22 nt, Artificial Sequence
  Synthetic
guugccugcaauuucgagauaa

SEQ ID NO: 24663 - RNA, 23 nt, Artificial Sequence
  Synthetic
aguugccugcaauuucgagauaa

SEQ ID NO: 24664 - RNA, 24 nt, Artificial Sequence
  Synthetic
caguugccugcaauuucgagauaa

SEQ ID NO: 24665 - RNA, 18 nt, Artificial Sequence
  Synthetic
agauuagugucuuuauaa

SEQ ID NO: 24666 - RNA, 19 nt, Artificial Sequence
  Synthetic
gagauuagugucuuuauaa

SEQ ID NO: 24667 - RNA, 20 nt, Artificial Sequence
  Synthetic
ugagauuagugucuuuauaa

SEQ ID NO: 24668 - RNA, 21 nt, Artificial Sequence
  Synthetic
augagauuagugucuuuauaa

SEQ ID NO: 24669 - RNA, 22 nt, Artificial Sequence
  Synthetic
aaugagauuagugucuuuauaa

SEQ ID NO: 24670 - RNA, 23 nt, Artificial Sequence
  Synthetic
aaaugagauuagugucuuuauaa

SEQ ID NO: 24671 - RNA, 24 nt, Artificial Sequence
  Synthetic
uaaaugagauuagugucuuuauaa

SEQ ID NO: 24672 - RNA, 18 nt, Artificial Sequence
  Synthetic
ugaccuaagauauccuaa

SEQ ID NO: 24673 - RNA, 19 nt, Artificial Sequence
  Synthetic
uugaccuaagauauccuaa

SEQ ID NO: 24674 - RNA, 21 nt, Artificial Sequence
  Synthetic
cuuugaccuaagauauccuaa

SEQ ID NO: 24675 - RNA, 22 nt, Artificial Sequence
  Synthetic
ucuuugaccuaagauauccuaa

SEQ ID NO: 24676 - RNA, 23 nt, Artificial Sequence
  Synthetic
cucuuugaccuaagauauccuaa

SEQ ID NO: 24677 - RNA, 24 nt, Artificial Sequence
  Synthetic
ccucuuugaccuaagauauccuaa

SEQ ID NO: 24678 - RNA, 18 nt, Artificial Sequence
  Synthetic
ggcuggauaagauucuaa

SEQ ID NO: 24679 - RNA, 19 nt, Artificial Sequence
  Synthetic
gggcuggauaagauucuaa

SEQ ID NO: 24680 - RNA, 21 nt, Artificial Sequence
  Synthetic
uggggcuggauaagauucuaa

SEQ ID NO: 24681 - RNA, 22 nt, Artificial Sequence
  Synthetic
auggggcuggauaagauucuaa

SEQ ID NO: 24682 - RNA, 23 nt, Artificial Sequence
  Synthetic
gauggggcuggauaagauucuaa

SEQ ID NO: 24683 - RNA, 24 nt, Artificial Sequence
  Synthetic
agauggggcuggauaagauucuaa

SEQ ID NO: 24684 - RNA, 18 nt, Artificial Sequence
  Synthetic
aguuuuaaacagaaguaa

SEQ ID NO: 24685 - RNA, 19 nt, Artificial Sequence
  Synthetic
gaguuuuaaacagaaguaa

SEQ ID NO: 24686 - RNA, 20 nt, Artificial Sequence
  Synthetic
agaguuuuaaacagaaguaa

SEQ ID NO: 24687 - RNA, 21 nt, Artificial Sequence
  Synthetic
gagaguuuuaaacagaaguaa

SEQ ID NO: 24688 - RNA, 22 nt, Artificial Sequence
  Synthetic
ggagaguuuuaaacagaaguaa

SEQ ID NO: 24689 - RNA, 23 nt, Artificial Sequence
  Synthetic
uggagaguuuuaaacagaaguaa

SEQ ID NO: 24690 - RNA, 24 nt, Artificial Sequence
  Synthetic
cuggagaguuuuaaacagaaguaa

SEQ ID NO: 24691 - RNA, 18 nt, Artificial Sequence
  Synthetic
aaagaaggaaggaaguaa

SEQ ID NO: 24692 - RNA, 19 nt, Artificial Sequence
  Synthetic
gaaagaaggaaggaaguaa

SEQ ID NO: 24693 - RNA, 20 nt, Artificial Sequence
  Synthetic
ggaaagaaggaaggaaguaa

SEQ ID NO: 24694 - RNA, 21 nt, Artificial Sequence
  Synthetic
aggaaagaaggaaggaaguaa

SEQ ID NO: 24695 - RNA, 22 nt, Artificial Sequence
  Synthetic
aaggaaagaaggaaggaaguaa

SEQ ID NO: 24696 - RNA, 23 nt, Artificial Sequence
  Synthetic
gaaggaaagaaggaaggaaguaa

SEQ ID NO: 24697 - RNA, 24 nt, Artificial Sequence
  Synthetic
ggaaggaaagaaggaaggaaguaa

SEQ ID NO: 24698 - RNA, 18 nt, Artificial Sequence
  Synthetic
gcuuucuggacugaguaa

SEQ ID NO: 24699 - RNA, 19 nt, Artificial Sequence
  Synthetic
agcuuucuggacugaguaa

SEQ ID NO: 24700 - RNA, 20 nt, Artificial Sequence
  Synthetic
aagcuuucuggacugaguaa

SEQ ID NO: 24701 - RNA, 21 nt, Artificial Sequence
  Synthetic
caagcuuucuggacugaguaa

SEQ ID NO: 24702 - RNA, 22 nt, Artificial Sequence
  Synthetic
ccaagcuuucuggacugaguaa

SEQ ID NO: 24703 - RNA, 23 nt, Artificial Sequence
  Synthetic
uccaagcuuucuggacugaguaa

SEQ ID NO: 24704 - RNA, 24 nt, Artificial Sequence
  Synthetic
uuccaagcuuucuggacugaguaa

SEQ ID NO: 24705 - RNA, 18 nt, Artificial Sequence
  Synthetic
gggugaagucuuuaguaa

SEQ ID NO: 24706 - RNA, 19 nt, Artificial Sequence
  Synthetic
agggugaagucuuuaguaa

SEQ ID NO: 24707 - RNA, 20 nt, Artificial Sequence
  Synthetic
gagggugaagucuuuaguaa

SEQ ID NO: 24708 - RNA, 21 nt, Artificial Sequence
  Synthetic
ugagggugaagucuuuaguaa

SEQ ID NO: 24709 - RNA, 22 nt, Artificial Sequence
  Synthetic
augagggugaagucuuuaguaa

SEQ ID NO: 24710 - RNA, 23 nt, Artificial Sequence
  Synthetic
caugagggugaagucuuuaguaa

SEQ ID NO: 24711 - RNA, 24 nt, Artificial Sequence
  Synthetic
ccaugagggugaagucuuuaguaa

SEQ ID NO: 24712 - RNA, 18 nt, Artificial Sequence
  Synthetic
auaaguggccuuuaaaca

SEQ ID NO: 24713 - RNA, 19 nt, Artificial Sequence
  Synthetic
uauaaguggccuuuaaaca

SEQ ID NO: 24714 - RNA, 20 nt, Artificial Sequence
  Synthetic
auauaaguggccuuuaaaca

SEQ ID NO: 24715 - RNA, 21 nt, Artificial Sequence
  Synthetic
aauauaaguggccuuuaaaca

SEQ ID NO: 24716 - RNA, 22 nt, Artificial Sequence
  Synthetic
aaauauaaguggccuuuaaaca

SEQ ID NO: 24717 - RNA, 23 nt, Artificial Sequence
  Synthetic
aaaauauaaguggccuuuaaaca

SEQ ID NO: 24718 - RNA, 24 nt, Artificial Sequence
  Synthetic
aaaaauauaaguggccuuuaaaca

SEQ ID NO: 24719 - RNA, 18 nt, Artificial Sequence
  Synthetic
accauccuggcuaacaca

SEQ ID NO: 24720 - RNA, 19 nt, Artificial Sequence
  Synthetic
gaccauccuggcuaacaca

SEQ ID NO: 24721 - RNA, 20 nt, Artificial Sequence
  Synthetic
agaccauccuggcuaacaca

SEQ ID NO: 24722 - RNA, 21 nt, Artificial Sequence
  Synthetic
aagaccauccuggcuaacaca

SEQ ID NO: 24723 - RNA, 22 nt, Artificial Sequence
  Synthetic
caagaccauccuggcuaacaca

SEQ ID NO: 24724 - RNA, 23 nt, Artificial Sequence
  Synthetic
ucaagaccauccuggcuaacaca

SEQ ID NO: 24725 - RNA, 24 nt, Artificial Sequence
  Synthetic
aucaagaccauccuggcuaacaca

SEQ ID NO: 24726 - RNA, 18 nt, Artificial Sequence
  Synthetic
caauauuuuguuaacaca

SEQ ID NO: 24727 - RNA, 19 nt, Artificial Sequence
  Synthetic
ccaauauuuuguuaacaca

SEQ ID NO: 24728 - RNA, 20 nt, Artificial Sequence
  Synthetic
uccaauauuuuguuaacaca

SEQ ID NO: 24729 - RNA, 21 nt, Artificial Sequence
  Synthetic
uuccaauauuuuguuaacaca

SEQ ID NO: 24730 - RNA, 22 nt, Artificial Sequence
  Synthetic
uuuccaauauuuuguuaacaca

SEQ ID NO: 24731 - RNA, 23 nt, Artificial Sequence
  Synthetic
guuuccaauauuuuguuaacaca

SEQ ID NO: 24732 - RNA, 24 nt, Artificial Sequence
  Synthetic
uguuuccaauauuuuguuaacaca

SEQ ID NO: 24733 - RNA, 18 nt, Artificial Sequence
  Synthetic
uuccauauucaaagcaca

SEQ ID NO: 24734 - RNA, 19 nt, Artificial Sequence
  Synthetic
uuuccauauucaaagcaca

SEQ ID NO: 24735 - RNA, 20 nt, Artificial Sequence
  Synthetic
cuuuccauauucaaagcaca

SEQ ID NO: 24736 - RNA, 21 nt, Artificial Sequence
  Synthetic
acuuuccauauucaaagcaca

SEQ ID NO: 24737 - RNA, 22 nt, Artificial Sequence
  Synthetic
aacuuuccauauucaaagcaca

SEQ ID NO: 24738 - RNA, 23 nt, Artificial Sequence
  Synthetic
caacuuuccauauucaaagcaca

SEQ ID NO: 24739 - RNA, 24 nt, Artificial Sequence
  Synthetic
acaacuuuccauauucaaagcaca

SEQ ID NO: 24740 - RNA, 18 nt, Artificial Sequence
  Synthetic
cauaugagaaaagucaca

SEQ ID NO: 24741 - RNA, 19 nt, Artificial Sequence
  Synthetic
gcauaugagaaaagucaca

SEQ ID NO: 24742 - RNA, 20 nt, Artificial Sequence
  Synthetic
ggcauaugagaaaagucaca

SEQ ID NO: 24743 - RNA, 21 nt, Artificial Sequence
  Synthetic
uggcauaugagaaaagucaca

SEQ ID NO: 24744 - RNA, 22 nt, Artificial Sequence
  Synthetic
auggcauaugagaaaagucaca

SEQ ID NO: 24745 - RNA, 23 nt, Artificial Sequence
  Synthetic
aauggcauaugagaaaagucaca

SEQ ID NO: 24746 - RNA, 24 nt, Artificial Sequence
  Synthetic
caauggcauaugagaaaagucaca

SEQ ID NO: 24747 - RNA, 18 nt, Artificial Sequence
  Synthetic
cuggcauagaguaagaca

SEQ ID NO: 24748 - RNA, 19 nt, Artificial Sequence
  Synthetic
gcuggcauagaguaagaca

SEQ ID NO: 24749 - RNA, 21 nt, Artificial Sequence
  Synthetic
aggcuggcauagaguaagaca

SEQ ID NO: 24750 - RNA, 22 nt, Artificial Sequence
  Synthetic
gaggcuggcauagaguaagaca

SEQ ID NO: 24751 - RNA, 23 nt, Artificial Sequence
  Synthetic
ugaggcuggcauagaguaagaca

SEQ ID NO: 24752 - RNA, 24 nt, Artificial Sequence
  Synthetic
cugaggcuggcauagaguaagaca

SEQ ID NO: 24753 - RNA, 18 nt, Artificial Sequence
  Synthetic
cuauucuguagggagaca

SEQ ID NO: 24754 - RNA, 19 nt, Artificial Sequence
  Synthetic
gcuauucuguagggagaca

SEQ ID NO: 24755 - RNA, 21 nt, Artificial Sequence
  Synthetic
aggcuauucuguagggagaca

SEQ ID NO: 24756 - RNA, 22 nt, Artificial Sequence
  Synthetic
uaggcuauucuguagggagaca

SEQ ID NO: 24757 - RNA, 23 nt, Artificial Sequence
  Synthetic
uuaggcuauucuguagggagaca

SEQ ID NO: 24758 - RNA, 24 nt, Artificial Sequence
  Synthetic
uuuaggcuauucuguagggagaca

SEQ ID NO: 24759 - RNA, 18 nt, Artificial Sequence
  Synthetic
uuuuuuucaguuaauaca

SEQ ID NO: 24760 - RNA, 19 nt, Artificial Sequence
  Synthetic
uuuuuuuucaguuaauaca

SEQ ID NO: 24761 - RNA, 20 nt, Artificial Sequence
  Synthetic
auuuuuuuucaguuaauaca

SEQ ID NO: 24762 - RNA, 21 nt, Artificial Sequence
  Synthetic
aauuuuuuuucaguuaauaca

SEQ ID NO: 24763 - RNA, 22 nt, Artificial Sequence
  Synthetic
gaauuuuuuuucaguuaauaca

SEQ ID NO: 24764 - RNA, 23 nt, Artificial Sequence
  Synthetic
ugaauuuuuuuucaguuaauaca

SEQ ID NO: 24765 - RNA, 24 nt, Artificial Sequence
  Synthetic
gugaauuuuuuuucaguuaauaca

SEQ ID NO: 24766 - RNA, 18 nt, Artificial Sequence
  Synthetic
aucauuucaacuuauaca

SEQ ID NO: 24767 - RNA, 19 nt, Artificial Sequence
  Synthetic
uaucauuucaacuuauaca

SEQ ID NO: 24768 - RNA, 20 nt, Artificial Sequence
  Synthetic
auaucauuucaacuuauaca

SEQ ID NO: 24769 - RNA, 21 nt, Artificial Sequence
  Synthetic
aauaucauuucaacuuauaca

SEQ ID NO: 24770 - RNA, 22 nt, Artificial Sequence
  Synthetic
aaauaucauuucaacuuauaca

SEQ ID NO: 24771 - RNA, 23 nt, Artificial Sequence
  Synthetic
aaaauaucauuucaacuuauaca

SEQ ID NO: 24772 - RNA, 24 nt, Artificial Sequence
  Synthetic
uaaaauaucauuucaacuuauaca

SEQ ID NO: 24773 - RNA, 18 nt, Artificial Sequence
  Synthetic
uagguuuaauuuuguaca

SEQ ID NO: 24774 - RNA, 19 nt, Artificial Sequence
  Synthetic
cuagguuuaauuuuguaca

SEQ ID NO: 24775 - RNA, 20 nt, Artificial Sequence
  Synthetic
ucuagguuuaauuuuguaca

SEQ ID NO: 24776 - RNA, 21 nt, Artificial Sequence
  Synthetic
uucuagguuuaauuuuguaca

SEQ ID NO: 24777 - RNA, 22 nt, Artificial Sequence
  Synthetic
cuucuagguuuaauuuuguaca

SEQ ID NO: 24778 - RNA, 23 nt, Artificial Sequence
  Synthetic
acuucuagguuuaauuuuguaca

SEQ ID NO: 24779 - RNA, 24 nt, Artificial Sequence
  Synthetic
cacuucuagguuuaauuuuguaca

SEQ ID NO: 24780 - RNA, 18 nt, Artificial Sequence
  Synthetic
gggugagauuagaggcca

SEQ ID NO: 24781 - RNA, 19 nt, Artificial Sequence
  Synthetic
ugggugagauuagaggcca

SEQ ID NO: 24782 - RNA, 20 nt, Artificial Sequence
  Synthetic
cugggugagauuagaggcca

SEQ ID NO: 24783 - RNA, 21 nt, Artificial Sequence
  Synthetic
ucugggugagauuagaggcca

SEQ ID NO: 24784 - RNA, 22 nt, Artificial Sequence
  Synthetic
cucugggugagauuagaggcca

SEQ ID NO: 24785 - RNA, 23 nt, Artificial Sequence
  Synthetic
ucucugggugagauuagaggcca

SEQ ID NO: 24786 - RNA, 24 nt, Artificial Sequence
  Synthetic
uucucugggugagauuagaggcca

SEQ ID NO: 24787 - RNA, 18 nt, Artificial Sequence
  Synthetic
cuuuccauauucaaagca

SEQ ID NO: 24788 - RNA, 19 nt, Artificial Sequence
  Synthetic
acuuuccauauucaaagca

SEQ ID NO: 24789 - RNA, 20 nt, Artificial Sequence
  Synthetic
aacuuuccauauucaaagca

SEQ ID NO: 24790 - RNA, 21 nt, Artificial Sequence
  Synthetic
caacuuuccauauucaaagca

SEQ ID NO: 24791 - RNA, 22 nt, Artificial Sequence
  Synthetic
acaacuuuccauauucaaagca

SEQ ID NO: 24792 - RNA, 23 nt, Artificial Sequence
  Synthetic
gacaacuuuccauauucaaagca

SEQ ID NO: 24793 - RNA, 24 nt, Artificial Sequence
  Synthetic
ggacaacuuuccauauucaaagca

SEQ ID NO: 24794 - RNA, 18 nt, Artificial Sequence
  Synthetic
gagacaagggaggaagca

SEQ ID NO: 24795 - RNA, 19 nt, Artificial Sequence
  Synthetic
ggagacaagggaggaagca

SEQ ID NO: 24796 - RNA, 21 nt, Artificial Sequence
  Synthetic
agggagacaagggaggaagca

SEQ ID NO: 24797 - RNA, 22 nt, Artificial Sequence
  Synthetic
uagggagacaagggaggaagca

SEQ ID NO: 24798 - RNA, 23 nt, Artificial Sequence
  Synthetic
guagggagacaagggaggaagca

SEQ ID NO: 24799 - RNA, 24 nt, Artificial Sequence
  Synthetic
uguagggagacaagggaggaagca

SEQ ID NO: 24800 - RNA, 18 nt, Artificial Sequence
  Synthetic
gauucuguuuaaauagca

SEQ ID NO: 24801 - RNA, 19 nt, Artificial Sequence
  Synthetic
ugauucuguuuaaauagca

SEQ ID NO: 24802 - RNA, 20 nt, Artificial Sequence
  Synthetic
cugauucuguuuaaauagca

SEQ ID NO: 24803 - RNA, 21 nt, Artificial Sequence
  Synthetic
ccugauucuguuuaaauagca

SEQ ID NO: 24804 - RNA, 22 nt, Artificial Sequence
  Synthetic
cccugauucuguuuaaauagca

SEQ ID NO: 24805 - RNA, 23 nt, Artificial Sequence
  Synthetic
ccccugauucuguuuaaauagca

SEQ ID NO: 24806 - RNA, 24 nt, Artificial Sequence
  Synthetic
uccccugauucuguuuaaauagca

SEQ ID NO: 24807 - RNA, 18 nt, Artificial Sequence
  Synthetic
agugccacuagugaugca

SEQ ID NO: 24808 - RNA, 19 nt, Artificial Sequence
  Synthetic
aagugccacuagugaugca

SEQ ID NO: 24809 - RNA, 21 nt, Artificial Sequence
  Synthetic
caaagugccacuagugaugca

SEQ ID NO: 24810 - RNA, 22 nt, Artificial Sequence
  Synthetic
acaaagugccacuagugaugca

SEQ ID NO: 24811 - RNA, 23 nt, Artificial Sequence
  Synthetic
uacaaagugccacuagugaugca

SEQ ID NO: 24812 - RNA, 24 nt, Artificial Sequence
  Synthetic
auacaaagugccacuagugaugca

SEQ ID NO: 24813 - RNA, 18 nt, Artificial Sequence
  Synthetic
ugagaaguggaggcugca

SEQ ID NO: 24814 - RNA, 19 nt, Artificial Sequence
  Synthetic
cugagaaguggaggcugca

SEQ ID NO: 24815 - RNA, 20 nt, Artificial Sequence
  Synthetic
ccugagaaguggaggcugca

SEQ ID NO: 24816 - RNA, 21 nt, Artificial Sequence
  Synthetic
gccugagaaguggaggcugca

SEQ ID NO: 24817 - RNA, 22 nt, Artificial Sequence
  Synthetic
agccugagaaguggaggcugca

SEQ ID NO: 24818 - RNA, 23 nt, Artificial Sequence
  Synthetic
gagccugagaaguggaggcugca

SEQ ID NO: 24819 - RNA, 24 nt, Artificial Sequence
  Synthetic
ugagccugagaaguggaggcugca

SEQ ID NO: 24820 - RNA, 18 nt, Artificial Sequence
  Synthetic
caggaggcagaacuugca

SEQ ID NO: 24821 - RNA, 19 nt, Artificial Sequence
  Synthetic
ccaggaggcagaacuugca

SEQ ID NO: 24822 - RNA, 20 nt, Artificial Sequence
  Synthetic
cccaggaggcagaacuugca

SEQ ID NO: 24823 - RNA, 21 nt, Artificial Sequence
  Synthetic
acccaggaggcagaacuugca

SEQ ID NO: 24824 - RNA, 22 nt, Artificial Sequence
  Synthetic
aacccaggaggcagaacuugca

SEQ ID NO: 24825 - RNA, 23 nt, Artificial Sequence
  Synthetic
gaacccaggaggcagaacuugca

SEQ ID NO: 24826 - RNA, 24 nt, Artificial Sequence
  Synthetic
ugaacccaggaggcagaacuugca

SEQ ID NO: 24827 - RNA, 18 nt, Artificial Sequence
  Synthetic
ggcauaugagaaaaguca

SEQ ID NO: 24828 - RNA, 19 nt, Artificial Sequence
  Synthetic
uggcauaugagaaaaguca

SEQ ID NO: 24829 - RNA, 20 nt, Artificial Sequence
  Synthetic
auggcauaugagaaaaguca

SEQ ID NO: 24830 - RNA, 21 nt, Artificial Sequence
  Synthetic
aauggcauaugagaaaaguca

SEQ ID NO: 24831 - RNA, 22 nt, Artificial Sequence
  Synthetic
caauggcauaugagaaaaguca

SEQ ID NO: 24832 - RNA, 23 nt, Artificial Sequence
  Synthetic
acaauggcauaugagaaaaguca

SEQ ID NO: 24833 - RNA, 24 nt, Artificial Sequence
  Synthetic
aacaauggcauaugagaaaaguca

SEQ ID NO: 24834 - RNA, 18 nt, Artificial Sequence
  Synthetic
agaacaguaaggagguca

SEQ ID NO: 24835 - RNA, 19 nt, Artificial Sequence
  Synthetic
aagaacaguaaggagguca

SEQ ID NO: 24836 - RNA, 20 nt, Artificial Sequence
  Synthetic
gaagaacaguaaggagguca

SEQ ID NO: 24837 - RNA, 21 nt, Artificial Sequence
  Synthetic
ugaagaacaguaaggagguca

SEQ ID NO: 24838 - RNA, 22 nt, Artificial Sequence
  Synthetic
uugaagaacaguaaggagguca

SEQ ID NO: 24839 - RNA, 23 nt, Artificial Sequence
  Synthetic
uuugaagaacaguaaggagguca

SEQ ID NO: 24840 - RNA, 24 nt, Artificial Sequence
  Synthetic
guuugaagaacaguaaggagguca

SEQ ID NO: 24841 - RNA, 18 nt, Artificial Sequence
  Synthetic
gaggguagaauacuguca

SEQ ID NO: 24842 - RNA, 19 nt, Artificial Sequence
  Synthetic
ggaggguagaauacuguca

SEQ ID NO: 24843 - RNA, 20 nt, Artificial Sequence
  Synthetic
gggaggguagaauacuguca

SEQ ID NO: 24844 - RNA, 21 nt, Artificial Sequence
  Synthetic
agggaggguagaauacuguca

SEQ ID NO: 24845 - RNA, 22 nt, Artificial Sequence
  Synthetic
cagggaggguagaauacuguca

SEQ ID NO: 24846 - RNA, 23 nt, Artificial Sequence
  Synthetic
acagggaggguagaauacuguca

SEQ ID NO: 24847 - RNA, 24 nt, Artificial Sequence
  Synthetic
gacagggaggguagaauacuguca

SEQ ID NO: 24848 - RNA, 18 nt, Artificial Sequence
  Synthetic
uguacaagucuaguuuca

SEQ ID NO: 24849 - RNA, 19 nt, Artificial Sequence
  Synthetic
auguacaagucuaguuuca

SEQ ID NO: 24850 - RNA, 21 nt, Artificial Sequence
  Synthetic
ggauguacaagucuaguuuca

SEQ ID NO: 24851 - RNA, 22 nt, Artificial Sequence
  Synthetic
uggauguacaagucuaguuuca

SEQ ID NO: 24852 - RNA, 23 nt, Artificial Sequence
  Synthetic
uuggauguacaagucuaguuuca

SEQ ID NO: 24853 - RNA, 24 nt, Artificial Sequence
  Synthetic
guuggauguacaagucuaguuuca

SEQ ID NO: 24854 - RNA, 18 nt, Artificial Sequence
  Synthetic
aagacaaacagaaaaaga

SEQ ID NO: 24855 - RNA, 19 nt, Artificial Sequence
  Synthetic
uaagacaaacagaaaaaga

SEQ ID NO: 24856 - RNA, 20 nt, Artificial Sequence
  Synthetic
cuaagacaaacagaaaaaga

SEQ ID NO: 24857 - RNA, 21 nt, Artificial Sequence
  Synthetic
ucuaagacaaacagaaaaaga

SEQ ID NO: 24858 - RNA, 22 nt, Artificial Sequence
  Synthetic
aucuaagacaaacagaaaaaga

SEQ ID NO: 24859 - RNA, 23 nt, Artificial Sequence
  Synthetic
aaucuaagacaaacagaaaaaga

SEQ ID NO: 24860 - RNA, 24 nt, Artificial Sequence
  Synthetic
uaaucuaagacaaacagaaaaaga

SEQ ID NO: 24861 - RNA, 18 nt, Artificial Sequence
  Synthetic
caaacagaaaaagaaaga

SEQ ID NO: 24862 - RNA, 19 nt, Artificial Sequence
  Synthetic
acaaacagaaaaagaaaga

SEQ ID NO: 24863 - RNA, 20 nt, Artificial Sequence
  Synthetic
gacaaacagaaaaagaaaga

SEQ ID NO: 24864 - RNA, 21 nt, Artificial Sequence
  Synthetic
agacaaacagaaaaagaaaga

SEQ ID NO: 24865 - RNA, 22 nt, Artificial Sequence
  Synthetic
aagacaaacagaaaaagaaaga

SEQ ID NO: 24866 - RNA, 23 nt, Artificial Sequence
  Synthetic
uaagacaaacagaaaaagaaaga

SEQ ID NO: 24867 - RNA, 24 nt, Artificial Sequence
  Synthetic
cuaagacaaacagaaaaagaaaga

SEQ ID NO: 24868 - RNA, 18 nt, Artificial Sequence
  Synthetic
gagaggaaggaagaaaga

SEQ ID NO: 24869 - RNA, 19 nt, Artificial Sequence
  Synthetic
agagaggaaggaagaaaga

SEQ ID NO: 24870 - RNA, 21 nt, Artificial Sequence
  Synthetic
aaagagaggaaggaagaaaga

SEQ ID NO: 24871 - RNA, 22 nt, Artificial Sequence
  Synthetic
gaaagagaggaaggaagaaaga

SEQ ID NO: 24872 - RNA, 23 nt, Artificial Sequence
  Synthetic
agaaagagaggaaggaagaaaga

SEQ ID NO: 24873 - RNA, 24 nt, Artificial Sequence
  Synthetic
aagaaagagaggaaggaagaaaga

SEQ ID NO: 24874 - RNA, 18 nt, Artificial Sequence
  Synthetic
gaaggaaggaaggaaaga

SEQ ID NO: 24875 - RNA, 19 nt, Artificial Sequence
  Synthetic
ggaaggaaggaaggaaaga

SEQ ID NO: 24876 - RNA, 21 nt, Artificial Sequence
  Synthetic
gaggaaggaaggaaggaaaga

SEQ ID NO: 24877 - RNA, 22 nt, Artificial Sequence
  Synthetic
ggaggaaggaaggaaggaaaga

SEQ ID NO: 24878 - RNA, 23 nt, Artificial Sequence
  Synthetic
aggaggaaggaaggaaggaaaga

SEQ ID NO: 24879 - RNA, 24 nt, Artificial Sequence
  Synthetic
uaggaggaaggaaggaaggaaaga

SEQ ID NO: 24880 - RNA, 18 nt, Artificial Sequence
  Synthetic
gucuaguuucaaggaaga

SEQ ID NO: 24881 - RNA, 19 nt, Artificial Sequence
  Synthetic
agucuaguuucaaggaaga

SEQ ID NO: 24882 - RNA, 21 nt, Artificial Sequence
  Synthetic
caagucuaguuucaaggaaga

SEQ ID NO: 24883 - RNA, 22 nt, Artificial Sequence
  Synthetic
acaagucuaguuucaaggaaga

SEQ ID NO: 24884 - RNA, 23 nt, Artificial Sequence
  Synthetic
uacaagucuaguuucaaggaaga

SEQ ID NO: 24885 - RNA, 24 nt, Artificial Sequence
  Synthetic
guacaagucuaguuucaaggaaga

SEQ ID NO: 24886 - RNA, 18 nt, Artificial Sequence
  Synthetic
gaaagagaggaaggaaga

SEQ ID NO: 24887 - RNA, 19 nt, Artificial Sequence
  Synthetic
agaaagagaggaaggaaga

SEQ ID NO: 24888 - RNA, 20 nt, Artificial Sequence
  Synthetic
aagaaagagaggaaggaaga

SEQ ID NO: 24889 - RNA, 21 nt, Artificial Sequence
  Synthetic
aaagaaagagaggaaggaaga

SEQ ID NO: 24890 - RNA, 22 nt, Artificial Sequence
  Synthetic
aaaagaaagagaggaaggaaga

SEQ ID NO: 24891 - RNA, 23 nt, Artificial Sequence
  Synthetic
aaaaagaaagagaggaaggaaga

SEQ ID NO: 24892 - RNA, 24 nt, Artificial Sequence
  Synthetic
gaaaaagaaagagaggaaggaaga

SEQ ID NO: 24893 - RNA, 18 nt, Artificial Sequence
  Synthetic
agaaggaaaugaggaaga

SEQ ID NO: 24894 - RNA, 19 nt, Artificial Sequence
  Synthetic
aagaaggaaaugaggaaga

SEQ ID NO: 24895 - RNA, 20 nt, Artificial Sequence
  Synthetic
aaagaaggaaaugaggaaga

SEQ ID NO: 24896 - RNA, 21 nt, Artificial Sequence
  Synthetic
gaaagaaggaaaugaggaaga

SEQ ID NO: 24897 - RNA, 22 nt, Artificial Sequence
  Synthetic
agaaagaaggaaaugaggaaga

SEQ ID NO: 24898 - RNA, 23 nt, Artificial Sequence
  Synthetic
aagaaagaaggaaaugaggaaga

SEQ ID NO: 24899 - RNA, 24 nt, Artificial Sequence
  Synthetic
gaagaaagaaggaaaugaggaaga

SEQ ID NO: 24900 - RNA, 18 nt, Artificial Sequence
  Synthetic
gggcugguagugugaaga

SEQ ID NO: 24901 - RNA, 19 nt, Artificial Sequence
  Synthetic
ggggcugguagugugaaga

SEQ ID NO: 24902 - RNA, 21 nt, Artificial Sequence
  Synthetic
agggggcugguagugugaaga

SEQ ID NO: 24903 - RNA, 22 nt, Artificial Sequence
  Synthetic
gagggggcugguagugugaaga

SEQ ID NO: 24904 - RNA, 23 nt, Artificial Sequence
  Synthetic
agagggggcugguagugugaaga

SEQ ID NO: 24905 - RNA, 24 nt, Artificial Sequence
  Synthetic
aagagggggcugguagugugaaga

SEQ ID NO: 24906 - RNA, 18 nt, Artificial Sequence
  Synthetic
agaaggaaggaaguaaga

SEQ ID NO: 24907 - RNA, 19 nt, Artificial Sequence
  Synthetic
aagaaggaaggaaguaaga

SEQ ID NO: 24908 - RNA, 21 nt, Artificial Sequence
  Synthetic
gaaagaaggaaggaaguaaga

SEQ ID NO: 24909 - RNA, 22 nt, Artificial Sequence
  Synthetic
ggaaagaaggaaggaaguaaga

SEQ ID NO: 24910 - RNA, 23 nt, Artificial Sequence
  Synthetic
aggaaagaaggaaggaaguaaga

SEQ ID NO: 24911 - RNA, 24 nt, Artificial Sequence
  Synthetic
aaggaaagaaggaaggaaguaaga

SEQ ID NO: 24912 - RNA, 18 nt, Artificial Sequence
  Synthetic
ggcuggcauagaguaaga

SEQ ID NO: 24913 - RNA, 19 nt, Artificial Sequence
  Synthetic
aggcuggcauagaguaaga

SEQ ID NO: 24914 - RNA, 20 nt, Artificial Sequence
  Synthetic
gaggcuggcauagaguaaga

SEQ ID NO: 24915 - RNA, 21 nt, Artificial Sequence
  Synthetic
ugaggcuggcauagaguaaga

SEQ ID NO: 24916 - RNA, 22 nt, Artificial Sequence
  Synthetic
cugaggcuggcauagaguaaga

SEQ ID NO: 24917 - RNA, 23 nt, Artificial Sequence
  Synthetic
acugaggcuggcauagaguaaga

SEQ ID NO: 24918 - RNA, 24 nt, Artificial Sequence
  Synthetic
cacugaggcuggcauagaguaaga

SEQ ID NO: 24919 - RNA, 18 nt, Artificial Sequence
  Synthetic
ucuagccugggugacaga

SEQ ID NO: 24920 - RNA, 19 nt, Artificial Sequence
  Synthetic
cucuagccugggugacaga

SEQ ID NO: 24921 - RNA, 20 nt, Artificial Sequence
  Synthetic
acucuagccugggugacaga

SEQ ID NO: 24922 - RNA, 21 nt, Artificial Sequence
  Synthetic
cacucuagccugggugacaga

SEQ ID NO: 24923 - RNA, 22 nt, Artificial Sequence
  Synthetic
gcacucuagccugggugacaga

SEQ ID NO: 24924 - RNA, 23 nt, Artificial Sequence
  Synthetic
ugcacucuagccugggugacaga

SEQ ID NO: 24925 - RNA, 24 nt, Artificial Sequence
  Synthetic
cugcacucuagccugggugacaga

SEQ ID NO: 24926 - RNA, 18 nt, Artificial Sequence
  Synthetic
aggucaaacuugaccaga

SEQ ID NO: 24927 - RNA, 19 nt, Artificial Sequence
  Synthetic
aaggucaaacuugaccaga

SEQ ID NO: 24928 - RNA, 20 nt, Artificial Sequence
  Synthetic
gaaggucaaacuugaccaga

SEQ ID NO: 24929 - RNA, 21 nt, Artificial Sequence
  Synthetic
agaaggucaaacuugaccaga

SEQ ID NO: 24930 - RNA, 22 nt, Artificial Sequence
  Synthetic
gagaaggucaaacuugaccaga

SEQ ID NO: 24931 - RNA, 23 nt, Artificial Sequence
  Synthetic
agagaaggucaaacuugaccaga

SEQ ID NO: 24932 - RNA, 24 nt, Artificial Sequence
  Synthetic
uagagaaggucaaacuugaccaga

SEQ ID NO: 24933 - RNA, 18 nt, Artificial Sequence
  Synthetic
aauuuaacauuuuccaga

SEQ ID NO: 24934 - RNA, 19 nt, Artificial Sequence
  Synthetic
aaauuuaacauuuuccaga

SEQ ID NO: 24935 - RNA, 20 nt, Artificial Sequence
  Synthetic
aaaauuuaacauuuuccaga

SEQ ID NO: 24936 - RNA, 21 nt, Artificial Sequence
  Synthetic
gaaaauuuaacauuuuccaga

SEQ ID NO: 24937 - RNA, 22 nt, Artificial Sequence
  Synthetic
ggaaaauuuaacauuuuccaga

SEQ ID NO: 24938 - RNA, 23 nt, Artificial Sequence
  Synthetic
gggaaaauuuaacauuuuccaga

SEQ ID NO: 24939 - RNA, 24 nt, Artificial Sequence
  Synthetic
agggaaaauuuaacauuuuccaga

SEQ ID NO: 24940 - RNA, 18 nt, Artificial Sequence
  Synthetic
aagugcaaagcuuucaga

SEQ ID NO: 24941 - RNA, 19 nt, Artificial Sequence
  Synthetic
caagugcaaagcuuucaga

SEQ ID NO: 24942 - RNA, 21 nt, Artificial Sequence
  Synthetic
agcaagugcaaagcuuucaga

SEQ ID NO: 24943 - RNA, 22 nt, Artificial Sequence
  Synthetic
aagcaagugcaaagcuuucaga

SEQ ID NO: 24944 - RNA, 23 nt, Artificial Sequence
  Synthetic
gaagcaagugcaaagcuuucaga

SEQ ID NO: 24945 - RNA, 24 nt, Artificial Sequence
  Synthetic
ugaagcaagugcaaagcuuucaga

SEQ ID NO: 24946 - RNA, 18 nt, Artificial Sequence
  Synthetic
aggguugauaagaagaga

SEQ ID NO: 24947 - RNA, 19 nt, Artificial Sequence
  Synthetic
gaggguugauaagaagaga

SEQ ID NO: 24948 - RNA, 20 nt, Artificial Sequence
  Synthetic
agaggguugauaagaagaga

SEQ ID NO: 24949 - RNA, 21 nt, Artificial Sequence
  Synthetic
aagaggguugauaagaagaga

SEQ ID NO: 24950 - RNA, 22 nt, Artificial Sequence
  Synthetic
aaagaggguugauaagaagaga

SEQ ID NO: 24951 - RNA, 23 nt, Artificial Sequence
  Synthetic
gaaagaggguugauaagaagaga

SEQ ID NO: 24952 - RNA, 24 nt, Artificial Sequence
  Synthetic
ggaaagaggguugauaagaagaga

SEQ ID NO: 24953 - RNA, 18 nt, Artificial Sequence
  Synthetic
aucaaauuagagaugaga

SEQ ID NO: 24954 - RNA, 19 nt, Artificial Sequence
  Synthetic
aaucaaauuagagaugaga

SEQ ID NO: 24955 - RNA, 20 nt, Artificial Sequence
  Synthetic
gaaucaaauuagagaugaga

SEQ ID NO: 24956 - RNA, 21 nt, Artificial Sequence
  Synthetic
agaaucaaauuagagaugaga

SEQ ID NO: 24957 - RNA, 22 nt, Artificial Sequence
  Synthetic
aagaaucaaauuagagaugaga

SEQ ID NO: 24958 - RNA, 23 nt, Artificial Sequence
  Synthetic
aaagaaucaaauuagagaugaga

SEQ ID NO: 24959 - RNA, 24 nt, Artificial Sequence
  Synthetic
gaaagaaucaaauuagagaugaga

SEQ ID NO: 24960 - RNA, 18 nt, Artificial Sequence
  Synthetic
aaaaaauaguagauuaga

SEQ ID NO: 24961 - RNA, 19 nt, Artificial Sequence
  Synthetic
gaaaaaauaguagauuaga

SEQ ID NO: 24962 - RNA, 20 nt, Artificial Sequence
  Synthetic
ugaaaaaauaguagauuaga

SEQ ID NO: 24963 - RNA, 21 nt, Artificial Sequence
  Synthetic
cugaaaaaauaguagauuaga

SEQ ID NO: 24964 - RNA, 22 nt, Artificial Sequence
  Synthetic
ucugaaaaaauaguagauuaga

SEQ ID NO: 24965 - RNA, 23 nt, Artificial Sequence
  Synthetic
aucugaaaaaauaguagauuaga

SEQ ID NO: 24966 - RNA, 24 nt, Artificial Sequence
  Synthetic
caucugaaaaaauaguagauuaga

SEQ ID NO: 24967 - RNA, 18 nt, Artificial Sequence
  Synthetic
gagcuuucuaguauuaga

SEQ ID NO: 24968 - RNA, 19 nt, Artificial Sequence
  Synthetic
agagcuuucuaguauuaga

SEQ ID NO: 24969 - RNA, 20 nt, Artificial Sequence
  Synthetic
aagagcuuucuaguauuaga

SEQ ID NO: 24970 - RNA, 21 nt, Artificial Sequence
  Synthetic
aaagagcuuucuaguauuaga

SEQ ID NO: 24971 - RNA, 22 nt, Artificial Sequence
  Synthetic
gaaagagcuuucuaguauuaga

SEQ ID NO: 24972 - RNA, 23 nt, Artificial Sequence
  Synthetic
agaaagagcuuucuaguauuaga

SEQ ID NO: 24973 - RNA, 24 nt, Artificial Sequence
  Synthetic
gagaaagagcuuucuaguauuaga

SEQ ID NO: 24974 - RNA, 18 nt, Artificial Sequence
  Synthetic
ggauaagauucuaaagga

SEQ ID NO: 24975 - RNA, 19 nt, Artificial Sequence
  Synthetic
uggauaagauucuaaagga

SEQ ID NO: 24976 - RNA, 20 nt, Artificial Sequence
  Synthetic
cuggauaagauucuaaagga

SEQ ID NO: 24977 - RNA, 21 nt, Artificial Sequence
  Synthetic
gcuggauaagauucuaaagga

SEQ ID NO: 24978 - RNA, 22 nt, Artificial Sequence
  Synthetic
ggcuggauaagauucuaaagga

SEQ ID NO: 24979 - RNA, 23 nt, Artificial Sequence
  Synthetic
gggcuggauaagauucuaaagga

SEQ ID NO: 24980 - RNA, 24 nt, Artificial Sequence
  Synthetic
ggggcuggauaagauucuaaagga

SEQ ID NO: 24981 - RNA, 18 nt, Artificial Sequence
  Synthetic
gaaggaaggaaagaagga

SEQ ID NO: 24982 - RNA, 19 nt, Artificial Sequence
  Synthetic
ggaaggaaggaaagaagga

SEQ ID NO: 24983 - RNA, 21 nt, Artificial Sequence
  Synthetic
aaggaaggaaggaaagaagga

SEQ ID NO: 24984 - RNA, 22 nt, Artificial Sequence
  Synthetic
gaaggaaggaaggaaagaagga

SEQ ID NO: 24985 - RNA, 23 nt, Artificial Sequence
  Synthetic
ggaaggaaggaaggaaagaagga

SEQ ID NO: 24986 - RNA, 24 nt, Artificial Sequence
  Synthetic
aggaaggaaggaaggaaagaagga

SEQ ID NO: 24987 - RNA, 18 nt, Artificial Sequence
  Synthetic
ggaggaaggaaggaagga

SEQ ID NO: 24988 - RNA, 19 nt, Artificial Sequence
  Synthetic
aggaggaaggaaggaagga

SEQ ID NO: 24989 - RNA, 20 nt, Artificial Sequence
  Synthetic
uaggaggaaggaaggaagga

SEQ ID NO: 24990 - RNA, 21 nt, Artificial Sequence
  Synthetic
guaggaggaaggaaggaagga

SEQ ID NO: 24991 - RNA, 22 nt, Artificial Sequence
  Synthetic
aguaggaggaaggaaggaagga

SEQ ID NO: 24992 - RNA, 23 nt, Artificial Sequence
  Synthetic
aaguaggaggaaggaaggaagga

SEQ ID NO: 24993 - RNA, 24 nt, Artificial Sequence
  Synthetic
gaaguaggaggaaggaaggaagga

SEQ ID NO: 24994 - RNA, 18 nt, Artificial Sequence
  Synthetic
aguaggaggaaggaagga

SEQ ID NO: 24995 - RNA, 19 nt, Artificial Sequence
  Synthetic
aaguaggaggaaggaagga

SEQ ID NO: 24996 - RNA, 21 nt, Artificial Sequence
  Synthetic
ggaaguaggaggaaggaagga

SEQ ID NO: 24997 - RNA, 22 nt, Artificial Sequence
  Synthetic
aggaaguaggaggaaggaagga

SEQ ID NO: 24998 - RNA, 23 nt, Artificial Sequence
  Synthetic
aaggaaguaggaggaaggaagga

SEQ ID NO: 24999 - RNA, 24 nt, Artificial Sequence
  Synthetic
aaaggaaguaggaggaaggaagga

SEQ ID NO: 25000 - RNA, 18 nt, Artificial Sequence
  Synthetic
aggaaguaggaggaagga

SEQ ID NO: 25001 - RNA, 19 nt, Artificial Sequence
  Synthetic
aaggaaguaggaggaagga

SEQ ID NO: 25002 - RNA, 21 nt, Artificial Sequence
  Synthetic
gaaaggaaguaggaggaagga

SEQ ID NO: 25003 - RNA, 22 nt, Artificial Sequence
  Synthetic
agaaaggaaguaggaggaagga

SEQ ID NO: 25004 - RNA, 23 nt, Artificial Sequence
  Synthetic
aagaaaggaaguaggaggaagga

SEQ ID NO: 25005 - RNA, 24 nt, Artificial Sequence
  Synthetic
gaagaaaggaaguaggaggaagga

SEQ ID NO: 25006 - RNA, 18 nt, Artificial Sequence
  Synthetic
uuagaaagaauaagagga

SEQ ID NO: 25007 - RNA, 19 nt, Artificial Sequence
  Synthetic
auuagaaagaauaagagga

SEQ ID NO: 25008 - RNA, 20 nt, Artificial Sequence
  Synthetic
aauuagaaagaauaagagga

SEQ ID NO: 25009 - RNA, 21 nt, Artificial Sequence
  Synthetic
aaauuagaaagaauaagagga

SEQ ID NO: 25010 - RNA, 22 nt, Artificial Sequence
  Synthetic
gaaauuagaaagaauaagagga

SEQ ID NO: 25011 - RNA, 23 nt, Artificial Sequence
  Synthetic
ugaaauuagaaagaauaagagga

SEQ ID NO: 25012 - RNA, 24 nt, Artificial Sequence
  Synthetic
augaaauuagaaagaauaagagga

SEQ ID NO: 25013 - RNA, 18 nt, Artificial Sequence
  Synthetic
agaaaaagaaagagagga

SEQ ID NO: 25014 - RNA, 19 nt, Artificial Sequence
  Synthetic
cagaaaaagaaagagagga

SEQ ID NO: 25015 - RNA, 21 nt, Artificial Sequence
  Synthetic
aacagaaaaagaaagagagga

SEQ ID NO: 25016 - RNA, 22 nt, Artificial Sequence
  Synthetic
aaacagaaaaagaaagagagga

SEQ ID NO: 25017 - RNA, 23 nt, Artificial Sequence
  Synthetic
caaacagaaaaagaaagagagga

SEQ ID NO: 25018 - RNA, 24 nt, Artificial Sequence
  Synthetic
acaaacagaaaaagaaagagagga

SEQ ID NO: 25019 - RNA, 18 nt, Artificial Sequence
  Synthetic
agaaaggaaguaggagga

SEQ ID NO: 25020 - RNA, 19 nt, Artificial Sequence
  Synthetic
aagaaaggaaguaggagga

SEQ ID NO: 25021 - RNA, 21 nt, Artificial Sequence
  Synthetic
ggaagaaaggaaguaggagga

SEQ ID NO: 25022 - RNA, 22 nt, Artificial Sequence
  Synthetic
aggaagaaaggaaguaggagga

SEQ ID NO: 25023 - RNA, 23 nt, Artificial Sequence
  Synthetic
gaggaagaaaggaaguaggagga

SEQ ID NO: 25024 - RNA, 24 nt, Artificial Sequence
  Synthetic
ugaggaagaaaggaaguaggagga

SEQ ID NO: 25025 - RNA, 18 nt, Artificial Sequence
  Synthetic
cuuuuaguaguauuagga

SEQ ID NO: 25026 - RNA, 19 nt, Artificial Sequence
  Synthetic
ccuuuuaguaguauuagga

SEQ ID NO: 25027 - RNA, 20 nt, Artificial Sequence
  Synthetic
gccuuuuaguaguauuagga

SEQ ID NO: 25028 - RNA, 21 nt, Artificial Sequence
  Synthetic
ugccuuuuaguaguauuagga

SEQ ID NO: 25029 - RNA, 22 nt, Artificial Sequence
  Synthetic
cugccuuuuaguaguauuagga

SEQ ID NO: 25030 - RNA, 23 nt, Artificial Sequence
  Synthetic
gcugccuuuuaguaguauuagga

SEQ ID NO: 25031 - RNA, 24 nt, Artificial Sequence
  Synthetic
ggcugccuuuuaguaguauuagga

SEQ ID NO: 25032 - RNA, 18 nt, Artificial Sequence
  Synthetic
ggagaaacagguuuugga

SEQ ID NO: 25033 - RNA, 19 nt, Artificial Sequence
  Synthetic
gggagaaacagguuuugga

SEQ ID NO: 25034 - RNA, 21 nt, Artificial Sequence
  Synthetic
augggagaaacagguuuugga

SEQ ID NO: 25035 - RNA, 22 nt, Artificial Sequence
  Synthetic
aaugggagaaacagguuuugga

SEQ ID NO: 25036 - RNA, 23 nt, Artificial Sequence
  Synthetic
uaaugggagaaacagguuuugga

SEQ ID NO: 25037 - RNA, 24 nt, Artificial Sequence
  Synthetic
auaaugggagaaacagguuuugga

SEQ ID NO: 25038 - RNA, 18 nt, Artificial Sequence
  Synthetic
aucacuggaugcccuuga

SEQ ID NO: 25039 - RNA, 19 nt, Artificial Sequence
  Synthetic
caucacuggaugcccuuga

SEQ ID NO: 25040 - RNA, 20 nt, Artificial Sequence
  Synthetic
gcaucacuggaugcccuuga

SEQ ID NO: 25041 - RNA, 21 nt, Artificial Sequence
  Synthetic
ugcaucacuggaugcccuuga

SEQ ID NO: 25042 - RNA, 22 nt, Artificial Sequence
  Synthetic
uugcaucacuggaugcccuuga

SEQ ID NO: 25043 - RNA, 23 nt, Artificial Sequence
  Synthetic
uuugcaucacuggaugcccuuga

SEQ ID NO: 25044 - RNA, 24 nt, Artificial Sequence
  Synthetic
uuuugcaucacuggaugcccuuga

SEQ ID NO: 25045 - RNA, 18 nt, Artificial Sequence
  Synthetic
auucaggacaugcuuuga

SEQ ID NO: 25046 - RNA, 19 nt, Artificial Sequence
  Synthetic
gauucaggacaugcuuuga

SEQ ID NO: 25047 - RNA, 21 nt, Artificial Sequence
  Synthetic
cagauucaggacaugcuuuga

SEQ ID NO: 25048 - RNA, 22 nt, Artificial Sequence
  Synthetic
ucagauucaggacaugcuuuga

SEQ ID NO: 25049 - RNA, 23 nt, Artificial Sequence
  Synthetic
aucagauucaggacaugcuuuga

SEQ ID NO: 25050 - RNA, 24 nt, Artificial Sequence
  Synthetic
gaucagauucaggacaugcuuuga

SEQ ID NO: 25051 - RNA, 18 nt, Artificial Sequence
  Synthetic
cugucuagccuagaaaua

SEQ ID NO: 25052 - RNA, 19 nt, Artificial Sequence
  Synthetic
acugucuagccuagaaaua

SEQ ID NO: 25053 - RNA, 20 nt, Artificial Sequence
  Synthetic
aacugucuagccuagaaaua

SEQ ID NO: 25054 - RNA, 21 nt, Artificial Sequence
  Synthetic
aaacugucuagccuagaaaua

SEQ ID NO: 25055 - RNA, 22 nt, Artificial Sequence
  Synthetic
caaacugucuagccuagaaaua

SEQ ID NO: 25056 - RNA, 23 nt, Artificial Sequence
  Synthetic
acaaacugucuagccuagaaaua

SEQ ID NO: 25057 - RNA, 24 nt, Artificial Sequence
  Synthetic
cacaaacugucuagccuagaaaua

SEQ ID NO: 25058 - RNA, 18 nt, Artificial Sequence
  Synthetic
ccggugucuucugaaaua

SEQ ID NO: 25059 - RNA, 19 nt, Artificial Sequence
  Synthetic
accggugucuucugaaaua

SEQ ID NO: 25060 - RNA, 21 nt, Artificial Sequence
  Synthetic
uaaccggugucuucugaaaua

SEQ ID NO: 25061 - RNA, 22 nt, Artificial Sequence
  Synthetic
uuaaccggugucuucugaaaua

SEQ ID NO: 25062 - RNA, 23 nt, Artificial Sequence
  Synthetic
auuaaccggugucuucugaaaua

SEQ ID NO: 25063 - RNA, 24 nt, Artificial Sequence
  Synthetic
aauuaaccggugucuucugaaaua

SEQ ID NO: 25064 - RNA, 18 nt, Artificial Sequence
  Synthetic
agugauccuagaaucaua

SEQ ID NO: 25065 - RNA, 19 nt, Artificial Sequence
  Synthetic
aagugauccuagaaucaua

SEQ ID NO: 25066 - RNA, 20 nt, Artificial Sequence
  Synthetic
aaagugauccuagaaucaua

SEQ ID NO: 25067 - RNA, 21 nt, Artificial Sequence
  Synthetic
uaaagugauccuagaaucaua

SEQ ID NO: 25068 - RNA, 22 nt, Artificial Sequence
  Synthetic
auaaagugauccuagaaucaua

SEQ ID NO: 25069 - RNA, 23 nt, Artificial Sequence
  Synthetic
uauaaagugauccuagaaucaua

SEQ ID NO: 25070 - RNA, 24 nt, Artificial Sequence
  Synthetic
auauaaagugauccuagaaucaua

SEQ ID NO: 25071 - RNA, 18 nt, Artificial Sequence
  Synthetic
ccguuuacuagaaagaua

SEQ ID NO: 25072 - RNA, 19 nt, Artificial Sequence
  Synthetic
gccguuuacuagaaagaua

SEQ ID NO: 25073 - RNA, 20 nt, Artificial Sequence
  Synthetic
ugccguuuacuagaaagaua

SEQ ID NO: 25074 - RNA, 21 nt, Artificial Sequence
  Synthetic
gugccguuuacuagaaagaua

SEQ ID NO: 25075 - RNA, 22 nt, Artificial Sequence
  Synthetic
ugugccguuuacuagaaagaua

SEQ ID NO: 25076 - RNA, 23 nt, Artificial Sequence
  Synthetic
augugccguuuacuagaaagaua

SEQ ID NO: 25077 - RNA, 24 nt, Artificial Sequence
  Synthetic
aaugugccguuuacuagaaagaua

SEQ ID NO: 25078 - RNA, 18 nt, Artificial Sequence
  Synthetic
cuugguauuuaccauaua

SEQ ID NO: 25079 - RNA, 19 nt, Artificial Sequence
  Synthetic
gcuugguauuuaccauaua

SEQ ID NO: 25080 - RNA, 20 nt, Artificial Sequence
  Synthetic
ugcuugguauuuaccauaua

SEQ ID NO: 25081 - RNA, 21 nt, Artificial Sequence
  Synthetic
uugcuugguauuuaccauaua

SEQ ID NO: 25082 - RNA, 22 nt, Artificial Sequence
  Synthetic
guugcuugguauuuaccauaua

SEQ ID NO: 25083 - RNA, 23 nt, Artificial Sequence
  Synthetic
aguugcuugguauuuaccauaua

SEQ ID NO: 25084 - RNA, 24 nt, Artificial Sequence
  Synthetic
gaguugcuugguauuuaccauaua

SEQ ID NO: 25085 - RNA, 18 nt, Artificial Sequence
  Synthetic
uuacacucuagcauuaua

SEQ ID NO: 25086 - RNA, 19 nt, Artificial Sequence
  Synthetic
auuacacucuagcauuaua

SEQ ID NO: 25087 - RNA, 20 nt, Artificial Sequence
  Synthetic
aauuacacucuagcauuaua

SEQ ID NO: 25088 - RNA, 21 nt, Artificial Sequence
  Synthetic
uaauuacacucuagcauuaua

SEQ ID NO: 25089 - RNA, 22 nt, Artificial Sequence
  Synthetic
auaauuacacucuagcauuaua

SEQ ID NO: 25090 - RNA, 23 nt, Artificial Sequence
  Synthetic
uauaauuacacucuagcauuaua

SEQ ID NO: 25091 - RNA, 24 nt, Artificial Sequence
  Synthetic
uuauaauuacacucuagcauuaua

SEQ ID NO: 25092 - RNA, 18 nt, Artificial Sequence
  Synthetic
aaaguuucucaucuuaua

SEQ ID NO: 25093 - RNA, 19 nt, Artificial Sequence
  Synthetic
aaaaguuucucaucuuaua

SEQ ID NO: 25094 - RNA, 21 nt, Artificial Sequence
  Synthetic
uaaaaaguuucucaucuuaua

SEQ ID NO: 25095 - RNA, 22 nt, Artificial Sequence
  Synthetic
uuaaaaaguuucucaucuuaua

SEQ ID NO: 25096 - RNA, 23 nt, Artificial Sequence
  Synthetic
uuuaaaaaguuucucaucuuaua

SEQ ID NO: 25097 - RNA, 24 nt, Artificial Sequence
  Synthetic
auuuaaaaaguuucucaucuuaua

SEQ ID NO: 25098 - RNA, 18 nt, Artificial Sequence
  Synthetic
guacaaaggaauuuuaua

SEQ ID NO: 25099 - RNA, 19 nt, Artificial Sequence
  Synthetic
uguacaaaggaauuuuaua

SEQ ID NO: 25100 - RNA, 20 nt, Artificial Sequence
  Synthetic
uuguacaaaggaauuuuaua

SEQ ID NO: 25101 - RNA, 21 nt, Artificial Sequence
  Synthetic
uuuguacaaaggaauuuuaua

SEQ ID NO: 25102 - RNA, 22 nt, Artificial Sequence
  Synthetic
uuuuguacaaaggaauuuuaua

SEQ ID NO: 25103 - RNA, 23 nt, Artificial Sequence
  Synthetic
auuuuguacaaaggaauuuuaua

SEQ ID NO: 25104 - RNA, 24 nt, Artificial Sequence
  Synthetic
aauuuuguacaaaggaauuuuaua

SEQ ID NO: 25105 - RNA, 18 nt, Artificial Sequence
  Synthetic
cuugcucucuuuuaacua

SEQ ID NO: 25106 - RNA, 19 nt, Artificial Sequence
  Synthetic
acuugcucucuuuuaacua

SEQ ID NO: 25107 - RNA, 20 nt, Artificial Sequence
  Synthetic
aacuugcucucuuuuaacua

SEQ ID NO: 25108 - RNA, 21 nt, Artificial Sequence
  Synthetic
aaacuugcucucuuuuaacua

SEQ ID NO: 25109 - RNA, 22 nt, Artificial Sequence
  Synthetic
aaaacuugcucucuuuuaacua

SEQ ID NO: 25110 - RNA, 23 nt, Artificial Sequence
  Synthetic
aaaaacuugcucucuuuuaacua

SEQ ID NO: 25111 - RNA, 24 nt, Artificial Sequence
  Synthetic
uaaaaacuugcucucuuuuaacua

SEQ ID NO: 25112 - RNA, 18 nt, Artificial Sequence
  Synthetic
uauuaaaaaauuauacua

SEQ ID NO: 25113 - RNA, 19 nt, Artificial Sequence
  Synthetic
cuauuaaaaaauuauacua

SEQ ID NO: 25114 - RNA, 20 nt, Artificial Sequence
  Synthetic
acuauuaaaaaauuauacua

SEQ ID NO: 25115 - RNA, 21 nt, Artificial Sequence
  Synthetic
cacuauuaaaaaauuauacua

SEQ ID NO: 25116 - RNA, 22 nt, Artificial Sequence
  Synthetic
ucacuauuaaaaaauuauacua

SEQ ID NO: 25117 - RNA, 23 nt, Artificial Sequence
  Synthetic
uucacuauuaaaaaauuauacua

SEQ ID NO: 25118 - RNA, 24 nt, Artificial Sequence
  Synthetic
guucacuauuaaaaaauuauacua

SEQ ID NO: 25119 - RNA, 18 nt, Artificial Sequence
  Synthetic
uugaccuaagauauccua

SEQ ID NO: 25120 - RNA, 19 nt, Artificial Sequence
  Synthetic
uuugaccuaagauauccua

SEQ ID NO: 25121 - RNA, 21 nt, Artificial Sequence
  Synthetic
ucuuugaccuaagauauccua

SEQ ID NO: 25122 - RNA, 22 nt, Artificial Sequence
  Synthetic
cucuuugaccuaagauauccua

SEQ ID NO: 25123 - RNA, 23 nt, Artificial Sequence
  Synthetic
ccucuuugaccuaagauauccua

SEQ ID NO: 25124 - RNA, 24 nt, Artificial Sequence
  Synthetic
uccucuuugaccuaagauauccua

SEQ ID NO: 25125 - RNA, 18 nt, Artificial Sequence
  Synthetic
uaguauuagaaugggcua

SEQ ID NO: 25126 - RNA, 19 nt, Artificial Sequence
  Synthetic
cuaguauuagaaugggcua

SEQ ID NO: 25127 - RNA, 20 nt, Artificial Sequence
  Synthetic
ucuaguauuagaaugggcua

SEQ ID NO: 25128 - RNA, 21 nt, Artificial Sequence
  Synthetic
uucuaguauuagaaugggcua

SEQ ID NO: 25129 - RNA, 22 nt, Artificial Sequence
  Synthetic
uuucuaguauuagaaugggcua

SEQ ID NO: 25130 - RNA, 23 nt, Artificial Sequence
  Synthetic
cuuucuaguauuagaaugggcua

SEQ ID NO: 25131 - RNA, 24 nt, Artificial Sequence
  Synthetic
gcuuucuaguauuagaaugggcua

SEQ ID NO: 25132 - RNA, 18 nt, Artificial Sequence
  Synthetic
gggcuggauaagauucua

SEQ ID NO: 25133 - RNA, 19 nt, Artificial Sequence
  Synthetic
ggggcuggauaagauucua

SEQ ID NO: 25134 - RNA, 20 nt, Artificial Sequence
  Synthetic
uggggcuggauaagauucua

SEQ ID NO: 25135 - RNA, 21 nt, Artificial Sequence
  Synthetic
auggggcuggauaagauucua

SEQ ID NO: 25136 - RNA, 22 nt, Artificial Sequence
  Synthetic
gauggggcuggauaagauucua

SEQ ID NO: 25137 - RNA, 23 nt, Artificial Sequence
  Synthetic
agauggggcuggauaagauucua

SEQ ID NO: 25138 - RNA, 24 nt, Artificial Sequence
  Synthetic
aagauggggcuggauaagauucua

SEQ ID NO: 25139 - RNA, 18 nt, Artificial Sequence
  Synthetic
cugguuugaagaacagua

SEQ ID NO: 25140 - RNA, 19 nt, Artificial Sequence
  Synthetic
ucugguuugaagaacagua

SEQ ID NO: 25141 - RNA, 21 nt, Artificial Sequence
  Synthetic
ugucugguuugaagaacagua

SEQ ID NO: 25142 - RNA, 22 nt, Artificial Sequence
  Synthetic
cugucugguuugaagaacagua

SEQ ID NO: 25143 - RNA, 23 nt, Artificial Sequence
  Synthetic
ccugucugguuugaagaacagua

SEQ ID NO: 25144 - RNA, 24 nt, Artificial Sequence
  Synthetic
accugucugguuugaagaacagua

SEQ ID NO: 25145 - RNA, 18 nt, Artificial Sequence
  Synthetic
cuggcaccauucacagua

SEQ ID NO: 25146 - RNA, 19 nt, Artificial Sequence
  Synthetic
ccuggcaccauucacagua

SEQ ID NO: 25147 - RNA, 20 nt, Artificial Sequence
  Synthetic
accuggcaccauucacagua

SEQ ID NO: 25148 - RNA, 21 nt, Artificial Sequence
  Synthetic
uaccuggcaccauucacagua

SEQ ID NO: 25149 - RNA, 22 nt, Artificial Sequence
  Synthetic
cuaccuggcaccauucacagua

SEQ ID NO: 25150 - RNA, 23 nt, Artificial Sequence
  Synthetic
ccuaccuggcaccauucacagua

SEQ ID NO: 25151 - RNA, 24 nt, Artificial Sequence
  Synthetic
cccuaccuggcaccauucacagua

SEQ ID NO: 25152 - RNA, 18 nt, Artificial Sequence
  Synthetic
uuaaugaaagcaauagua

SEQ ID NO: 25153 - RNA, 19 nt, Artificial Sequence
  Synthetic
cuuaaugaaagcaauagua

SEQ ID NO: 25154 - RNA, 20 nt, Artificial Sequence
  Synthetic
acuuaaugaaagcaauagua

SEQ ID NO: 25155 - RNA, 21 nt, Artificial Sequence
  Synthetic
gacuuaaugaaagcaauagua

SEQ ID NO: 25156 - RNA, 22 nt, Artificial Sequence
  Synthetic
ugacuuaaugaaagcaauagua

SEQ ID NO: 25157 - RNA, 23 nt, Artificial Sequence
  Synthetic
gugacuuaaugaaagcaauagua

SEQ ID NO: 25158 - RNA, 24 nt, Artificial Sequence
  Synthetic
cgugacuuaaugaaagcaauagua

SEQ ID NO: 25159 - RNA, 18 nt, Artificial Sequence
  Synthetic
ggcuugauccagguagua

SEQ ID NO: 25160 - RNA, 19 nt, Artificial Sequence
  Synthetic
uggcuugauccagguagua

SEQ ID NO: 25161 - RNA, 20 nt, Artificial Sequence
  Synthetic
guggcuugauccagguagua

SEQ ID NO: 25162 - RNA, 21 nt, Artificial Sequence
  Synthetic
gguggcuugauccagguagua

SEQ ID NO: 25163 - RNA, 22 nt, Artificial Sequence
  Synthetic
ugguggcuugauccagguagua

SEQ ID NO: 25164 - RNA, 23 nt, Artificial Sequence
  Synthetic
augguggcuugauccagguagua

SEQ ID NO: 25165 - RNA, 24 nt, Artificial Sequence
  Synthetic
gaugguggcuugauccagguagua

SEQ ID NO: 25166 - RNA, 18 nt, Artificial Sequence
  Synthetic
uuuuuaggcuauucugua

SEQ ID NO: 25167 - RNA, 19 nt, Artificial Sequence
  Synthetic
guuuuuaggcuauucugua

SEQ ID NO: 25168 - RNA, 21 nt, Artificial Sequence
  Synthetic
auguuuuuaggcuauucugua

SEQ ID NO: 25169 - RNA, 22 nt, Artificial Sequence
  Synthetic
aauguuuuuaggcuauucugua

SEQ ID NO: 25170 - RNA, 23 nt, Artificial Sequence
  Synthetic
uaauguuuuuaggcuauucugua

SEQ ID NO: 25171 - RNA, 24 nt, Artificial Sequence
  Synthetic
cuaauguuuuuaggcuauucugua

SEQ ID NO: 25172 - RNA, 18 nt, Artificial Sequence
  Synthetic
cacuugacagguauauua

SEQ ID NO: 25173 - RNA, 19 nt, Artificial Sequence
  Synthetic
gcacuugacagguauauua

SEQ ID NO: 25174 - RNA, 20 nt, Artificial Sequence
  Synthetic
agcacuugacagguauauua

SEQ ID NO: 25175 - RNA, 21 nt, Artificial Sequence
  Synthetic
uagcacuugacagguauauua

SEQ ID NO: 25176 - RNA, 22 nt, Artificial Sequence
  Synthetic
cuagcacuugacagguauauua

SEQ ID NO: 25177 - RNA, 23 nt, Artificial Sequence
  Synthetic
ccuagcacuugacagguauauua

SEQ ID NO: 25178 - RNA, 24 nt, Artificial Sequence
  Synthetic
gccuagcacuugacagguauauua

SEQ ID NO: 25179 - RNA, 18 nt, Artificial Sequence
  Synthetic
gagauaacucgugacuua

SEQ ID NO: 25180 - RNA, 19 nt, Artificial Sequence
  Synthetic
ggagauaacucgugacuua

SEQ ID NO: 25181 - RNA, 20 nt, Artificial Sequence
  Synthetic
cggagauaacucgugacuua

SEQ ID NO: 25182 - RNA, 21 nt, Artificial Sequence
  Synthetic
acggagauaacucgugacuua

SEQ ID NO: 25183 - RNA, 22 nt, Artificial Sequence
  Synthetic
uacggagauaacucgugacuua

SEQ ID NO: 25184 - RNA, 23 nt, Artificial Sequence
  Synthetic
auacggagauaacucgugacuua

SEQ ID NO: 25185 - RNA, 24 nt, Artificial Sequence
  Synthetic
aauacggagauaacucgugacuua

SEQ ID NO: 25186 - RNA, 18 nt, Artificial Sequence
  Synthetic
uuuauaaaagaaaccuua

SEQ ID NO: 25187 - RNA, 19 nt, Artificial Sequence
  Synthetic
cuuuauaaaagaaaccuua

SEQ ID NO: 25188 - RNA, 20 nt, Artificial Sequence
  Synthetic
ucuuuauaaaagaaaccuua

SEQ ID NO: 25189 - RNA, 21 nt, Artificial Sequence
  Synthetic
gucuuuauaaaagaaaccuua

SEQ ID NO: 25190 - RNA, 22 nt, Artificial Sequence
  Synthetic
ugucuuuauaaaagaaaccuua

SEQ ID NO: 25191 - RNA, 23 nt, Artificial Sequence
  Synthetic
gugucuuuauaaaagaaaccuua

SEQ ID NO: 25192 - RNA, 24 nt, Artificial Sequence
  Synthetic
agugucuuuauaaaagaaaccuua

SEQ ID NO: 25193 - RNA, 18 nt, Artificial Sequence
  Synthetic
agagacccucacaccuua

SEQ ID NO: 25194 - RNA, 19 nt, Artificial Sequence
  Synthetic
gagagacccucacaccuua

SEQ ID NO: 25195 - RNA, 20 nt, Artificial Sequence
  Synthetic
agagagacccucacaccuua

SEQ ID NO: 25196 - RNA, 21 nt, Artificial Sequence
  Synthetic
uagagagacccucacaccuua

SEQ ID NO: 25197 - RNA, 22 nt, Artificial Sequence
  Synthetic
uuagagagacccucacaccuua

SEQ ID NO: 25198 - RNA, 23 nt, Artificial Sequence
  Synthetic
cuuagagagacccucacaccuua

SEQ ID NO: 25199 - RNA, 24 nt, Artificial Sequence
  Synthetic
ccuuagagagacccucacaccuua

SEQ ID NO: 25200 - RNA, 18 nt, Artificial Sequence
  Synthetic
aaaaaguuucucaucuua

SEQ ID NO: 25201 - RNA, 19 nt, Artificial Sequence
  Synthetic
uaaaaaguuucucaucuua

SEQ ID NO: 25202 - RNA, 20 nt, Artificial Sequence
  Synthetic
uuaaaaaguuucucaucuua

SEQ ID NO: 25203 - RNA, 21 nt, Artificial Sequence
  Synthetic
uuuaaaaaguuucucaucuua

SEQ ID NO: 25204 - RNA, 22 nt, Artificial Sequence
  Synthetic
auuuaaaaaguuucucaucuua

SEQ ID NO: 25205 - RNA, 23 nt, Artificial Sequence
  Synthetic
aauuuaaaaaguuucucaucuua

SEQ ID NO: 25206 - RNA, 24 nt, Artificial Sequence
  Synthetic
uaauuuaaaaaguuucucaucuua

SEQ ID NO: 25207 - RNA, 18 nt, Artificial Sequence
  Synthetic
gcuaugaaggcagaguua

SEQ ID NO: 25208 - RNA, 19 nt, Artificial Sequence
  Synthetic
agcuaugaaggcagaguua

SEQ ID NO: 25209 - RNA, 20 nt, Artificial Sequence
  Synthetic
cagcuaugaaggcagaguua

SEQ ID NO: 25210 - RNA, 21 nt, Artificial Sequence
  Synthetic
gcagcuaugaaggcagaguua

SEQ ID NO: 25211 - RNA, 22 nt, Artificial Sequence
  Synthetic
agcagcuaugaaggcagaguua

SEQ ID NO: 25212 - RNA, 23 nt, Artificial Sequence
  Synthetic
aagcagcuaugaaggcagaguua

SEQ ID NO: 25213 - RNA, 24 nt, Artificial Sequence
  Synthetic
aaagcagcuaugaaggcagaguua

SEQ ID NO: 25214 - RNA, 18 nt, Artificial Sequence
  Synthetic
ucuaaguauuagagguua

SEQ ID NO: 25215 - RNA, 19 nt, Artificial Sequence
  Synthetic
uucuaaguauuagagguua

SEQ ID NO: 25216 - RNA, 21 nt, Artificial Sequence
  Synthetic
cauucuaaguauuagagguua

SEQ ID NO: 25217 - RNA, 22 nt, Artificial Sequence
  Synthetic
gcauucuaaguauuagagguua

SEQ ID NO: 25218 - RNA, 23 nt, Artificial Sequence
  Synthetic
ggcauucuaaguauuagagguua

SEQ ID NO: 25219 - RNA, 24 nt, Artificial Sequence
  Synthetic
gggcauucuaaguauuagagguua

SEQ ID NO: 25220 - RNA, 18 nt, Artificial Sequence
  Synthetic
cuguagguaaaaauguua

SEQ ID NO: 25221 - RNA, 19 nt, Artificial Sequence
  Synthetic
gcuguagguaaaaauguua

SEQ ID NO: 25222 - RNA, 20 nt, Artificial Sequence
  Synthetic
ugcuguagguaaaaauguua

SEQ ID NO: 25223 - RNA, 21 nt, Artificial Sequence
  Synthetic
cugcuguagguaaaaauguua

SEQ ID NO: 25224 - RNA, 22 nt, Artificial Sequence
  Synthetic
gcugcuguagguaaaaauguua

SEQ ID NO: 25225 - RNA, 23 nt, Artificial Sequence
  Synthetic
ugcugcuguagguaaaaauguua

SEQ ID NO: 25226 - RNA, 24 nt, Artificial Sequence
  Synthetic
cugcugcuguagguaaaaauguua

SEQ ID NO: 25227 - RNA, 18 nt, Artificial Sequence
  Synthetic
uaagaauuguaaaauuua

SEQ ID NO: 25228 - RNA, 19 nt, Artificial Sequence
  Synthetic
auaagaauuguaaaauuua

SEQ ID NO: 25229 - RNA, 20 nt, Artificial Sequence
  Synthetic
aauaagaauuguaaaauuua

SEQ ID NO: 25230 - RNA, 21 nt, Artificial Sequence
  Synthetic
uaauaagaauuguaaaauuua

SEQ ID NO: 25231 - RNA, 22 nt, Artificial Sequence
  Synthetic
guaauaagaauuguaaaauuua

SEQ ID NO: 25232 - RNA, 23 nt, Artificial Sequence
  Synthetic
uguaauaagaauuguaaaauuua

SEQ ID NO: 25233 - RNA, 24 nt, Artificial Sequence
  Synthetic
auguaauaagaauuguaaaauuua

SEQ ID NO: 25234 - RNA, 18 nt, Artificial Sequence
  Synthetic
cuuccuugaauuauuuua

SEQ ID NO: 25235 - RNA, 19 nt, Artificial Sequence
  Synthetic
acuuccuugaauuauuuua

SEQ ID NO: 25236 - RNA, 20 nt, Artificial Sequence
  Synthetic
aacuuccuugaauuauuuua

SEQ ID NO: 25237 - RNA, 21 nt, Artificial Sequence
  Synthetic
aaacuuccuugaauuauuuua

SEQ ID NO: 25238 - RNA, 22 nt, Artificial Sequence
  Synthetic
gaaacuuccuugaauuauuuua

SEQ ID NO: 25239 - RNA, 23 nt, Artificial Sequence
  Synthetic
ugaaacuuccuugaauuauuuua

SEQ ID NO: 25240 - RNA, 24 nt, Artificial Sequence
  Synthetic
augaaacuuccuugaauuauuuua

SEQ ID NO: 25241 - RNA, 18 nt, Artificial Sequence
  Synthetic
uguuauagcagccugaac

SEQ ID NO: 25242 - RNA, 19 nt, Artificial Sequence
  Synthetic
uuguuauagcagccugaac

SEQ ID NO: 25243 - RNA, 20 nt, Artificial Sequence
  Synthetic
uuuguuauagcagccugaac

SEQ ID NO: 25244 - RNA, 21 nt, Artificial Sequence
  Synthetic
uuuuguuauagcagccugaac

SEQ ID NO: 25245 - RNA, 22 nt, Artificial Sequence
  Synthetic
auuuuguuauagcagccugaac

SEQ ID NO: 25246 - RNA, 23 nt, Artificial Sequence
  Synthetic
uauuuuguuauagcagccugaac

SEQ ID NO: 25247 - RNA, 24 nt, Artificial Sequence
  Synthetic
guauuuuguuauagcagccugaac

SEQ ID NO: 25248 - RNA, 18 nt, Artificial Sequence
  Synthetic
gcuuauucuuguaauaac

SEQ ID NO: 25249 - RNA, 19 nt, Artificial Sequence
  Synthetic
agcuuauucuuguaauaac

SEQ ID NO: 25250 - RNA, 21 nt, Artificial Sequence
  Synthetic
uuagcuuauucuuguaauaac

SEQ ID NO: 25251 - RNA, 22 nt, Artificial Sequence
  Synthetic
uuuagcuuauucuuguaauaac

SEQ ID NO: 25252 - RNA, 23 nt, Artificial Sequence
  Synthetic
uuuuagcuuauucuuguaauaac

SEQ ID NO: 25253 - RNA, 24 nt, Artificial Sequence
  Synthetic
guuuuagcuuauucuuguaauaac

SEQ ID NO: 25254 - RNA, 18 nt, Artificial Sequence
  Synthetic
ggccugcauaugucuaac

SEQ ID NO: 25255 - RNA, 19 nt, Artificial Sequence
  Synthetic
gggccugcauaugucuaac

SEQ ID NO: 25256 - RNA, 20 nt, Artificial Sequence
  Synthetic
ugggccugcauaugucuaac

SEQ ID NO: 25257 - RNA, 21 nt, Artificial Sequence
  Synthetic
uugggccugcauaugucuaac

SEQ ID NO: 25258 - RNA, 22 nt, Artificial Sequence
  Synthetic
uuugggccugcauaugucuaac

SEQ ID NO: 25259 - RNA, 23 nt, Artificial Sequence
  Synthetic
auuugggccugcauaugucuaac

SEQ ID NO: 25260 - RNA, 24 nt, Artificial Sequence
  Synthetic
uauuugggccugcauaugucuaac

SEQ ID NO: 25261 - RNA, 18 nt, Artificial Sequence
  Synthetic
cuuucuggacugaguaac

SEQ ID NO: 25262 - RNA, 19 nt, Artificial Sequence
  Synthetic
gcuuucuggacugaguaac

SEQ ID NO: 25263 - RNA, 21 nt, Artificial Sequence
  Synthetic
aagcuuucuggacugaguaac

SEQ ID NO: 25264 - RNA, 22 nt, Artificial Sequence
  Synthetic
caagcuuucuggacugaguaac

SEQ ID NO: 25265 - RNA, 23 nt, Artificial Sequence
  Synthetic
ccaagcuuucuggacugaguaac

SEQ ID NO: 25266 - RNA, 24 nt, Artificial Sequence
  Synthetic
uccaagcuuucuggacugaguaac

SEQ ID NO: 25267 - RNA, 18 nt, Artificial Sequence
  Synthetic
ucauuucaacuuauacac

SEQ ID NO: 25268 - RNA, 19 nt, Artificial Sequence
  Synthetic
aucauuucaacuuauacac

SEQ ID NO: 25269 - RNA, 21 nt, Artificial Sequence
  Synthetic
auaucauuucaacuuauacac

SEQ ID NO: 25270 - RNA, 22 nt, Artificial Sequence
  Synthetic
aauaucauuucaacuuauacac

SEQ ID NO: 25271 - RNA, 23 nt, Artificial Sequence
  Synthetic
aaauaucauuucaacuuauacac

SEQ ID NO: 25272 - RNA, 24 nt, Artificial Sequence
  Synthetic
aaaauaucauuucaacuuauacac

SEQ ID NO: 25273 - RNA, 18 nt, Artificial Sequence
  Synthetic
ggugagauuagaggccac

SEQ ID NO: 25274 - RNA, 19 nt, Artificial Sequence
  Synthetic
gggugagauuagaggccac

SEQ ID NO: 25275 - RNA, 21 nt, Artificial Sequence
  Synthetic
cugggugagauuagaggccac

SEQ ID NO: 25276 - RNA, 22 nt, Artificial Sequence
  Synthetic
ucugggugagauuagaggccac

SEQ ID NO: 25277 - RNA, 23 nt, Artificial Sequence
  Synthetic
cucugggugagauuagaggccac

SEQ ID NO: 25278 - RNA, 24 nt, Artificial Sequence
  Synthetic
ucucugggugagauuagaggccac

SEQ ID NO: 25279 - RNA, 18 nt, Artificial Sequence
  Synthetic
cugaggugggaggaucac

SEQ ID NO: 25280 - RNA, 19 nt, Artificial Sequence
  Synthetic
gcugaggugggaggaucac

SEQ ID NO: 25281 - RNA, 20 nt, Artificial Sequence
  Synthetic
ggcugaggugggaggaucac

SEQ ID NO: 25282 - RNA, 21 nt, Artificial Sequence
  Synthetic
aggcugaggugggaggaucac

SEQ ID NO: 25283 - RNA, 22 nt, Artificial Sequence
  Synthetic
gaggcugaggugggaggaucac

SEQ ID NO: 25284 - RNA, 23 nt, Artificial Sequence
  Synthetic
ggaggcugaggugggaggaucac

SEQ ID NO: 25285 - RNA, 24 nt, Artificial Sequence
  Synthetic
gggaggcugaggugggaggaucac

SEQ ID NO: 25286 - RNA, 18 nt, Artificial Sequence
  Synthetic
guuugucuuuaauuucac

SEQ ID NO: 25287 - RNA, 19 nt, Artificial Sequence
  Synthetic
gguuugucuuuaauuucac

SEQ ID NO: 25288 - RNA, 20 nt, Artificial Sequence
  Synthetic
agguuugucuuuaauuucac

SEQ ID NO: 25289 - RNA, 21 nt, Artificial Sequence
  Synthetic
uagguuugucuuuaauuucac

SEQ ID NO: 25290 - RNA, 22 nt, Artificial Sequence
  Synthetic
uuagguuugucuuuaauuucac

SEQ ID NO: 25291 - RNA, 23 nt, Artificial Sequence
  Synthetic
guuagguuugucuuuaauuucac

SEQ ID NO: 25292 - RNA, 24 nt, Artificial Sequence
  Synthetic
aguuagguuugucuuuaauuucac

SEQ ID NO: 25293 - RNA, 18 nt, Artificial Sequence
  Synthetic
ggaaauaaauuuaaagac

SEQ ID NO: 25294 - RNA, 19 nt, Artificial Sequence
  Synthetic
aggaaauaaauuuaaagac

SEQ ID NO: 25295 - RNA, 20 nt, Artificial Sequence
  Synthetic
gaggaaauaaauuuaaagac

SEQ ID NO: 25296 - RNA, 21 nt, Artificial Sequence
  Synthetic
ugaggaaauaaauuuaaagac

SEQ ID NO: 25297 - RNA, 22 nt, Artificial Sequence
  Synthetic
uugaggaaauaaauuuaaagac

SEQ ID NO: 25298 - RNA, 23 nt, Artificial Sequence
  Synthetic
auugaggaaauaaauuuaaagac

SEQ ID NO: 25299 - RNA, 24 nt, Artificial Sequence
  Synthetic
uauugaggaaauaaauuuaaagac

SEQ ID NO: 25300 - RNA, 18 nt, Artificial Sequence
  Synthetic
gcuggcauagaguaagac

SEQ ID NO: 25301 - RNA, 19 nt, Artificial Sequence
  Synthetic
ggcuggcauagaguaagac

SEQ ID NO: 25302 - RNA, 21 nt, Artificial Sequence
  Synthetic
gaggcuggcauagaguaagac

SEQ ID NO: 25303 - RNA, 22 nt, Artificial Sequence
  Synthetic
ugaggcuggcauagaguaagac

SEQ ID NO: 25304 - RNA, 23 nt, Artificial Sequence
  Synthetic
cugaggcuggcauagaguaagac

SEQ ID NO: 25305 - RNA, 24 nt, Artificial Sequence
  Synthetic
acugaggcuggcauagaguaagac

SEQ ID NO: 25306 - RNA, 18 nt, Artificial Sequence
  Synthetic
gcuauucuguagggagac

SEQ ID NO: 25307 - RNA, 19 nt, Artificial Sequence
  Synthetic
ggcuauucuguagggagac

SEQ ID NO: 25308 - RNA, 20 nt, Artificial Sequence
  Synthetic
aggcuauucuguagggagac

SEQ ID NO: 25309 - RNA, 21 nt, Artificial Sequence
  Synthetic
uaggcuauucuguagggagac

SEQ ID NO: 25310 - RNA, 22 nt, Artificial Sequence
  Synthetic
uuaggcuauucuguagggagac

SEQ ID NO: 25311 - RNA, 23 nt, Artificial Sequence
  Synthetic
uuuaggcuauucuguagggagac

SEQ ID NO: 25312 - RNA, 24 nt, Artificial Sequence
  Synthetic
uuuuaggcuauucuguagggagac

SEQ ID NO: 25313 - RNA, 18 nt, Artificial Sequence
  Synthetic
aagaauugaauaugagac

SEQ ID NO: 25314 - RNA, 19 nt, Artificial Sequence
  Synthetic
gaagaauugaauaugagac

SEQ ID NO: 25315 - RNA, 20 nt, Artificial Sequence
  Synthetic
ugaagaauugaauaugagac

SEQ ID NO: 25316 - RNA, 21 nt, Artificial Sequence
  Synthetic
uugaagaauugaauaugagac

SEQ ID NO: 25317 - RNA, 22 nt, Artificial Sequence
  Synthetic
uuugaagaauugaauaugagac

SEQ ID NO: 25318 - RNA, 23 nt, Artificial Sequence
  Synthetic
uuuugaagaauugaauaugagac

SEQ ID NO: 25319 - RNA, 24 nt, Artificial Sequence
  Synthetic
auuuugaagaauugaauaugagac

SEQ ID NO: 25320 - RNA, 18 nt, Artificial Sequence
  Synthetic
gcccguagucccagcuac

SEQ ID NO: 25321 - RNA, 19 nt, Artificial Sequence
  Synthetic
ugcccguagucccagcuac

SEQ ID NO: 25322 - RNA, 20 nt, Artificial Sequence
  Synthetic
gugcccguagucccagcuac

SEQ ID NO: 25323 - RNA, 21 nt, Artificial Sequence
  Synthetic
ggugcccguagucccagcuac

SEQ ID NO: 25324 - RNA, 22 nt, Artificial Sequence
  Synthetic
gggugcccguagucccagcuac

SEQ ID NO: 25325 - RNA, 23 nt, Artificial Sequence
  Synthetic
cgggugcccguagucccagcuac

SEQ ID NO: 25326 - RNA, 24 nt, Artificial Sequence
  Synthetic
gcgggugcccguagucccagcuac

SEQ ID NO: 25327 - RNA, 21 nt, Artificial Sequence
  Synthetic
ugugccuguagucccagcuac

SEQ ID NO: 25328 - RNA, 22 nt, Artificial Sequence
  Synthetic
gugugccuguagucccagcuac

SEQ ID NO: 25329 - RNA, 23 nt, Artificial Sequence
  Synthetic
ugugugccuguagucccagcuac

SEQ ID NO: 25330 - RNA, 24 nt, Artificial Sequence
  Synthetic
gugugugccuguagucccagcuac

SEQ ID NO: 25331 - RNA, 18 nt, Artificial Sequence
  Synthetic
gaaaaguuguaacaguac

SEQ ID NO: 25332 - RNA, 19 nt, Artificial Sequence
  Synthetic
ggaaaaguuguaacaguac

SEQ ID NO: 25333 - RNA, 20 nt, Artificial Sequence
  Synthetic
cggaaaaguuguaacaguac

SEQ ID NO: 25334 - RNA, 21 nt, Artificial Sequence
  Synthetic
acggaaaaguuguaacaguac

SEQ ID NO: 25335 - RNA, 22 nt, Artificial Sequence
  Synthetic
cacggaaaaguuguaacaguac

SEQ ID NO: 25336 - RNA, 23 nt, Artificial Sequence
  Synthetic
gcacggaaaaguuguaacaguac

SEQ ID NO: 25337 - RNA, 24 nt, Artificial Sequence
  Synthetic
ugcacggaaaaguuguaacaguac

SEQ ID NO: 25338 - RNA, 18 nt, Artificial Sequence
  Synthetic
gauaaaugugccguuuac

SEQ ID NO: 25339 - RNA, 19 nt, Artificial Sequence
  Synthetic
ggauaaaugugccguuuac

SEQ ID NO: 25340 - RNA, 20 nt, Artificial Sequence
  Synthetic
aggauaaaugugccguuuac

SEQ ID NO: 25341 - RNA, 21 nt, Artificial Sequence
  Synthetic
aaggauaaaugugccguuuac

SEQ ID NO: 25342 - RNA, 22 nt, Artificial Sequence
  Synthetic
gaaggauaaaugugccguuuac

SEQ ID NO: 25343 - RNA, 23 nt, Artificial Sequence
  Synthetic
ggaaggauaaaugugccguuuac

SEQ ID NO: 25344 - RNA, 24 nt, Artificial Sequence
  Synthetic
uggaaggauaaaugugccguuuac

SEQ ID NO: 25345 - RNA, 18 nt, Artificial Sequence
  Synthetic
ucauagcucacuguaacc

SEQ ID NO: 25346 - RNA, 19 nt, Artificial Sequence
  Synthetic
aucauagcucacuguaacc

SEQ ID NO: 25347 - RNA, 20 nt, Artificial Sequence
  Synthetic
gaucauagcucacuguaacc

SEQ ID NO: 25348 - RNA, 21 nt, Artificial Sequence
  Synthetic
ugaucauagcucacuguaacc

SEQ ID NO: 25349 - RNA, 22 nt, Artificial Sequence
  Synthetic
gugaucauagcucacuguaacc

SEQ ID NO: 25350 - RNA, 23 nt, Artificial Sequence
  Synthetic
ugugaucauagcucacuguaacc

SEQ ID NO: 25351 - RNA, 24 nt, Artificial Sequence
  Synthetic
gugugaucauagcucacuguaacc

SEQ ID NO: 25352 - RNA, 18 nt, Artificial Sequence
  Synthetic
gucuagccuagaaauacc

SEQ ID NO: 25353 - RNA, 19 nt, Artificial Sequence
  Synthetic
ugucuagccuagaaauacc

SEQ ID NO: 25354 - RNA, 20 nt, Artificial Sequence
  Synthetic
cugucuagccuagaaauacc

SEQ ID NO: 25355 - RNA, 21 nt, Artificial Sequence
  Synthetic
acugucuagccuagaaauacc

SEQ ID NO: 25356 - RNA, 22 nt, Artificial Sequence
  Synthetic
aacugucuagccuagaaauacc

SEQ ID NO: 25357 - RNA, 23 nt, Artificial Sequence
  Synthetic
aaacugucuagccuagaaauacc

SEQ ID NO: 25358 - RNA, 24 nt, Artificial Sequence
  Synthetic
caaacugucuagccuagaaauacc

SEQ ID NO: 25359 - RNA, 18 nt, Artificial Sequence
  Synthetic
gaggaaggcagugguccc

SEQ ID NO: 25360 - RNA, 19 nt, Artificial Sequence
  Synthetic
agaggaaggcagugguccc

SEQ ID NO: 25361 - RNA, 20 nt, Artificial Sequence
  Synthetic
uagaggaaggcagugguccc

SEQ ID NO: 25362 - RNA, 21 nt, Artificial Sequence
  Synthetic
uuagaggaaggcagugguccc

SEQ ID NO: 25363 - RNA, 22 nt, Artificial Sequence
  Synthetic
guuagaggaaggcagugguccc

SEQ ID NO: 25364 - RNA, 23 nt, Artificial Sequence
  Synthetic
aguuagaggaaggcagugguccc

SEQ ID NO: 25365 - RNA, 24 nt, Artificial Sequence
  Synthetic
gaguuagaggaaggcagugguccc

SEQ ID NO: 25366 - RNA, 18 nt, Artificial Sequence
  Synthetic
cucacaaacugucuagcc

SEQ ID NO: 25367 - RNA, 19 nt, Artificial Sequence
  Synthetic
acucacaaacugucuagcc

SEQ ID NO: 25368 - RNA, 20 nt, Artificial Sequence
  Synthetic
aacucacaaacugucuagcc

SEQ ID NO: 25369 - RNA, 21 nt, Artificial Sequence
  Synthetic
aaacucacaaacugucuagcc

SEQ ID NO: 25370 - RNA, 22 nt, Artificial Sequence
  Synthetic
aaaacucacaaacugucuagcc

SEQ ID NO: 25371 - RNA, 23 nt, Artificial Sequence
  Synthetic
aaaaacucacaaacugucuagcc

SEQ ID NO: 25372 - RNA, 24 nt, Artificial Sequence
  Synthetic
aaaaaacucacaaacugucuagcc

SEQ ID NO: 25373 - RNA, 18 nt, Artificial Sequence
  Synthetic
ugaaugaaugugguaucc

SEQ ID NO: 25374 - RNA, 19 nt, Artificial Sequence
  Synthetic
gugaaugaaugugguaucc

SEQ ID NO: 25375 - RNA, 21 nt, Artificial Sequence
  Synthetic
uagugaaugaaugugguaucc

SEQ ID NO: 25376 - RNA, 22 nt, Artificial Sequence
  Synthetic
cuagugaaugaaugugguaucc

SEQ ID NO: 25377 - RNA, 23 nt, Artificial Sequence
  Synthetic
gcuagugaaugaaugugguaucc

SEQ ID NO: 25378 - RNA, 24 nt, Artificial Sequence
  Synthetic
agcuagugaaugaaugugguaucc

SEQ ID NO: 25379 - RNA, 18 nt, Artificial Sequence
  Synthetic
uugggaggugauuagucc

SEQ ID NO: 25380 - RNA, 19 nt, Artificial Sequence
  Synthetic
uuugggaggugauuagucc

SEQ ID NO: 25381 - RNA, 20 nt, Artificial Sequence
  Synthetic
cuuugggaggugauuagucc

SEQ ID NO: 25382 - RNA, 21 nt, Artificial Sequence
  Synthetic
ccuuugggaggugauuagucc

SEQ ID NO: 25383 - RNA, 22 nt, Artificial Sequence
  Synthetic
gccuuugggaggugauuagucc

SEQ ID NO: 25384 - RNA, 23 nt, Artificial Sequence
  Synthetic
ggccuuugggaggugauuagucc

SEQ ID NO: 25385 - RNA, 24 nt, Artificial Sequence
  Synthetic
gggccuuugggaggugauuagucc

SEQ ID NO: 25386 - RNA, 18 nt, Artificial Sequence
  Synthetic
ucuuuauuuuuauauucc

SEQ ID NO: 25387 - RNA, 19 nt, Artificial Sequence
  Synthetic
uucuuuauuuuuauauucc

SEQ ID NO: 25388 - RNA, 20 nt, Artificial Sequence
  Synthetic
cuucuuuauuuuuauauucc

SEQ ID NO: 25389 - RNA, 21 nt, Artificial Sequence
  Synthetic
ucuucuuuauuuuuauauucc

SEQ ID NO: 25390 - RNA, 22 nt, Artificial Sequence
  Synthetic
gucuucuuuauuuuuauauucc

SEQ ID NO: 25391 - RNA, 23 nt, Artificial Sequence
  Synthetic
ugucuucuuuauuuuuauauucc

SEQ ID NO: 25392 - RNA, 24 nt, Artificial Sequence
  Synthetic
augucuucuuuauuuuuauauucc

SEQ ID NO: 25393 - RNA, 18 nt, Artificial Sequence
  Synthetic
guugucaaauguccuucc

SEQ ID NO: 25394 - RNA, 19 nt, Artificial Sequence
  Synthetic
uguugucaaauguccuucc

SEQ ID NO: 25395 - RNA, 20 nt, Artificial Sequence
  Synthetic
auguugucaaauguccuucc

SEQ ID NO: 25396 - RNA, 21 nt, Artificial Sequence
  Synthetic
gauguugucaaauguccuucc

SEQ ID NO: 25397 - RNA, 22 nt, Artificial Sequence
  Synthetic
agauguugucaaauguccuucc

SEQ ID NO: 25398 - RNA, 23 nt, Artificial Sequence
  Synthetic
uagauguugucaaauguccuucc

SEQ ID NO: 25399 - RNA, 24 nt, Artificial Sequence
  Synthetic
guagauguugucaaauguccuucc

SEQ ID NO: 25400 - RNA, 18 nt, Artificial Sequence
  Synthetic
cuuuuuuuaguaucuucc

SEQ ID NO: 25401 - RNA, 19 nt, Artificial Sequence
  Synthetic
acuuuuuuuaguaucuucc

SEQ ID NO: 25402 - RNA, 20 nt, Artificial Sequence
  Synthetic
aacuuuuuuuaguaucuucc

SEQ ID NO: 25403 - RNA, 21 nt, Artificial Sequence
  Synthetic
uaacuuuuuuuaguaucuucc

SEQ ID NO: 25404 - RNA, 22 nt, Artificial Sequence
  Synthetic
guaacuuuuuuuaguaucuucc

SEQ ID NO: 25405 - RNA, 23 nt, Artificial Sequence
  Synthetic
gguaacuuuuuuuaguaucuucc

SEQ ID NO: 25406 - RNA, 24 nt, Artificial Sequence
  Synthetic
agguaacuuuuuuuaguaucuucc

SEQ ID NO: 25407 - RNA, 18 nt, Artificial Sequence
  Synthetic
ggagacaagggaggaagc

SEQ ID NO: 25408 - RNA, 19 nt, Artificial Sequence
  Synthetic
gggagacaagggaggaagc

SEQ ID NO: 25409 - RNA, 20 nt, Artificial Sequence
  Synthetic
agggagacaagggaggaagc

SEQ ID NO: 25410 - RNA, 21 nt, Artificial Sequence
  Synthetic
uagggagacaagggaggaagc

SEQ ID NO: 25411 - RNA, 22 nt, Artificial Sequence
  Synthetic
guagggagacaagggaggaagc

SEQ ID NO: 25412 - RNA, 23 nt, Artificial Sequence
  Synthetic
uguagggagacaagggaggaagc

SEQ ID NO: 25413 - RNA, 24 nt, Artificial Sequence
  Synthetic
cuguagggagacaagggaggaagc

SEQ ID NO: 25414 - RNA, 18 nt, Artificial Sequence
  Synthetic
gccaugugagaacacagc

SEQ ID NO: 25415 - RNA, 19 nt, Artificial Sequence
  Synthetic
ugccaugugagaacacagc

SEQ ID NO: 25416 - RNA, 21 nt, Artificial Sequence
  Synthetic
ucugccaugugagaacacagc

SEQ ID NO: 25417 - RNA, 22 nt, Artificial Sequence
  Synthetic
uucugccaugugagaacacagc

SEQ ID NO: 25418 - RNA, 23 nt, Artificial Sequence
  Synthetic
uuucugccaugugagaacacagc

SEQ ID NO: 25419 - RNA, 24 nt, Artificial Sequence
  Synthetic
cuuucugccaugugagaacacagc

SEQ ID NO: 25420 - RNA, 18 nt, Artificial Sequence
  Synthetic
caggaguuugagaccagc

SEQ ID NO: 25421 - RNA, 19 nt, Artificial Sequence
  Synthetic
ccaggaguuugagaccagc

SEQ ID NO: 25422 - RNA, 20 nt, Artificial Sequence
  Synthetic
uccaggaguuugagaccagc

SEQ ID NO: 25423 - RNA, 21 nt, Artificial Sequence
  Synthetic
guccaggaguuugagaccagc

SEQ ID NO: 25424 - RNA, 22 nt, Artificial Sequence
  Synthetic
aguccaggaguuugagaccagc

SEQ ID NO: 25425 - RNA, 23 nt, Artificial Sequence
  Synthetic
gaguccaggaguuugagaccagc

SEQ ID NO: 25426 - RNA, 24 nt, Artificial Sequence
  Synthetic
ugaguccaggaguuugagaccagc

SEQ ID NO: 25427 - RNA, 18 nt, Artificial Sequence
  Synthetic
guauuuuguuauagcagc

SEQ ID NO: 25428 - RNA, 19 nt, Artificial Sequence
  Synthetic
gguauuuuguuauagcagc

SEQ ID NO: 25429 - RNA, 20 nt, Artificial Sequence
  Synthetic
ugguauuuuguuauagcagc

SEQ ID NO: 25430 - RNA, 21 nt, Artificial Sequence
  Synthetic
augguauuuuguuauagcagc

SEQ ID NO: 25431 - RNA, 22 nt, Artificial Sequence
  Synthetic
caugguauuuuguuauagcagc

SEQ ID NO: 25432 - RNA, 23 nt, Artificial Sequence
  Synthetic
ucaugguauuuuguuauagcagc

SEQ ID NO: 25433 - RNA, 24 nt, Artificial Sequence
  Synthetic
uucaugguauuuuguuauagcagc

SEQ ID NO: 25434 - RNA, 18 nt, Artificial Sequence
  Synthetic
ugggaggaucaccugagc

SEQ ID NO: 25435 - RNA, 19 nt, Artificial Sequence
  Synthetic
gugggaggaucaccugagc

SEQ ID NO: 25436 - RNA, 20 nt, Artificial Sequence
  Synthetic
ggugggaggaucaccugagc

SEQ ID NO: 25437 - RNA, 21 nt, Artificial Sequence
  Synthetic
aggugggaggaucaccugagc

SEQ ID NO: 25438 - RNA, 22 nt, Artificial Sequence
  Synthetic
gaggugggaggaucaccugagc

SEQ ID NO: 25439 - RNA, 23 nt, Artificial Sequence
  Synthetic
ugaggugggaggaucaccugagc

SEQ ID NO: 25440 - RNA, 24 nt, Artificial Sequence
  Synthetic
cugaggugggaggaucaccugagc

SEQ ID NO: 25441 - RNA, 18 nt, Artificial Sequence
  Synthetic
cucacccucccaaguagc

SEQ ID NO: 25442 - RNA, 19 nt, Artificial Sequence
  Synthetic
ccucacccucccaaguagc

SEQ ID NO: 25443 - RNA, 21 nt, Artificial Sequence
  Synthetic
ugccucacccucccaaguagc

SEQ ID NO: 25444 - RNA, 22 nt, Artificial Sequence
  Synthetic
cugccucacccucccaaguagc

SEQ ID NO: 25445 - RNA, 23 nt, Artificial Sequence
  Synthetic
ccugccucacccucccaaguagc

SEQ ID NO: 25446 - RNA, 24 nt, Artificial Sequence
  Synthetic
uccugccucacccucccaaguagc

SEQ ID NO: 25447 - RNA, 18 nt, Artificial Sequence
  Synthetic
cucagccucccaaguagc

SEQ ID NO: 25448 - RNA, 19 nt, Artificial Sequence
  Synthetic
ccucagccucccaaguagc

SEQ ID NO: 25449 - RNA, 21 nt, Artificial Sequence
  Synthetic
ugccucagccucccaaguagc

SEQ ID NO: 25450 - RNA, 22 nt, Artificial Sequence
  Synthetic
cugccucagccucccaaguagc

SEQ ID NO: 25451 - RNA, 23 nt, Artificial Sequence
  Synthetic
ccugccucagccucccaaguagc

SEQ ID NO: 25452 - RNA, 24 nt, Artificial Sequence
  Synthetic
uccugccucagccucccaaguagc

SEQ ID NO: 25453 - RNA, 18 nt, Artificial Sequence
  Synthetic
cccuuaaacaauacaggc

SEQ ID NO: 25454 - RNA, 19 nt, Artificial Sequence
  Synthetic
acccuuaaacaauacaggc

SEQ ID NO: 25455 - RNA, 20 nt, Artificial Sequence
  Synthetic
gacccuuaaacaauacaggc

SEQ ID NO: 25456 - RNA, 21 nt, Artificial Sequence
  Synthetic
ugacccuuaaacaauacaggc

SEQ ID NO: 25457 - RNA, 22 nt, Artificial Sequence
  Synthetic
uugacccuuaaacaauacaggc

SEQ ID NO: 25458 - RNA, 23 nt, Artificial Sequence
  Synthetic
auugacccuuaaacaauacaggc

SEQ ID NO: 25459 - RNA, 24 nt, Artificial Sequence
  Synthetic
aauugacccuuaaacaauacaggc

SEQ ID NO: 25460 - RNA, 18 nt, Artificial Sequence
  Synthetic
agugcugggauuacaggc

SEQ ID NO: 25461 - RNA, 19 nt, Artificial Sequence
  Synthetic
aagugcugggauuacaggc

SEQ ID NO: 25462 - RNA, 20 nt, Artificial Sequence
  Synthetic
aaagugcugggauuacaggc

SEQ ID NO: 25463 - RNA, 21 nt, Artificial Sequence
  Synthetic
caaagugcugggauuacaggc

SEQ ID NO: 25464 - RNA, 22 nt, Artificial Sequence
  Synthetic
ccaaagugcugggauuacaggc

SEQ ID NO: 25465 - RNA, 23 nt, Artificial Sequence
  Synthetic
cccaaagugcugggauuacaggc

SEQ ID NO: 25466 - RNA, 24 nt, Artificial Sequence
  Synthetic
ucccaaagugcugggauuacaggc

SEQ ID NO: 25467 - RNA, 18 nt, Artificial Sequence
  Synthetic
aguguugggauuacaggc

SEQ ID NO: 25468 - RNA, 19 nt, Artificial Sequence
  Synthetic
aaguguugggauuacaggc

SEQ ID NO: 25469 - RNA, 20 nt, Artificial Sequence
  Synthetic
aaaguguugggauuacaggc

SEQ ID NO: 25470 - RNA, 21 nt, Artificial Sequence
  Synthetic
caaaguguugggauuacaggc

SEQ ID NO: 25471 - RNA, 22 nt, Artificial Sequence
  Synthetic
ccaaaguguugggauuacaggc

SEQ ID NO: 25472 - RNA, 23 nt, Artificial Sequence
  Synthetic
cccaaaguguugggauuacaggc

SEQ ID NO: 25473 - RNA, 24 nt, Artificial Sequence
  Synthetic
ucccaaaguguugggauuacaggc

SEQ ID NO: 25474 - RNA, 18 nt, Artificial Sequence
  Synthetic
gucuuacugucaccaggc

SEQ ID NO: 25475 - RNA, 19 nt, Artificial Sequence
  Synthetic
agucuuacugucaccaggc

SEQ ID NO: 25476 - RNA, 21 nt, Artificial Sequence
  Synthetic
agagucuuacugucaccaggc

SEQ ID NO: 25477 - RNA, 22 nt, Artificial Sequence
  Synthetic
cagagucuuacugucaccaggc

SEQ ID NO: 25478 - RNA, 23 nt, Artificial Sequence
  Synthetic
acagagucuuacugucaccaggc

SEQ ID NO: 25479 - RNA, 24 nt, Artificial Sequence
  Synthetic
gacagagucuuacugucaccaggc

SEQ ID NO: 25480 - RNA, 18 nt, Artificial Sequence
  Synthetic
uacucgggaggcugaggc

SEQ ID NO: 25481 - RNA, 19 nt, Artificial Sequence
  Synthetic
cuacucgggaggcugaggc

SEQ ID NO: 25482 - RNA, 21 nt, Artificial Sequence
  Synthetic
agcuacucgggaggcugaggc

SEQ ID NO: 25483 - RNA, 22 nt, Artificial Sequence
  Synthetic
cagcuacucgggaggcugaggc

SEQ ID NO: 25484 - RNA, 23 nt, Artificial Sequence
  Synthetic
ccagcuacucgggaggcugaggc

SEQ ID NO: 25485 - RNA, 24 nt, Artificial Sequence
  Synthetic
cccagcuacucgggaggcugaggc

SEQ ID NO: 25486 - RNA, 18 nt, Artificial Sequence
  Synthetic
agugcuggguuuauaggc

SEQ ID NO: 25487 - RNA, 19 nt, Artificial Sequence
  Synthetic
aagugcuggguuuauaggc

SEQ ID NO: 25488 - RNA, 20 nt, Artificial Sequence
  Synthetic
aaagugcuggguuuauaggc

SEQ ID NO: 25489 - RNA, 21 nt, Artificial Sequence
  Synthetic
caaagugcuggguuuauaggc

SEQ ID NO: 25490 - RNA, 22 nt, Artificial Sequence
  Synthetic
ccaaagugcuggguuuauaggc

SEQ ID NO: 25491 - RNA, 23 nt, Artificial Sequence
  Synthetic
cccaaagugcuggguuuauaggc

SEQ ID NO: 25492 - RNA, 24 nt, Artificial Sequence
  Synthetic
ucccaaagugcuggguuuauaggc

SEQ ID NO: 25493 - RNA, 18 nt, Artificial Sequence
  Synthetic
aagugccacuagugaugc

SEQ ID NO: 25494 - RNA, 19 nt, Artificial Sequence
  Synthetic
aaagugccacuagugaugc

SEQ ID NO: 25495 - RNA, 20 nt, Artificial Sequence
  Synthetic
caaagugccacuagugaugc

SEQ ID NO: 25496 - RNA, 21 nt, Artificial Sequence
  Synthetic
acaaagugccacuagugaugc

SEQ ID NO: 25497 - RNA, 22 nt, Artificial Sequence
  Synthetic
uacaaagugccacuagugaugc

SEQ ID NO: 25498 - RNA, 23 nt, Artificial Sequence
  Synthetic
auacaaagugccacuagugaugc

SEQ ID NO: 25499 - RNA, 24 nt, Artificial Sequence
  Synthetic
cauacaaagugccacuagugaugc

SEQ ID NO: 25500 - RNA, 18 nt, Artificial Sequence
  Synthetic
ucaaauuauuucuacugc

SEQ ID NO: 25501 - RNA, 19 nt, Artificial Sequence
  Synthetic
uucaaauuauuucuacugc

SEQ ID NO: 25502 - RNA, 20 nt, Artificial Sequence
  Synthetic
guucaaauuauuucuacugc

SEQ ID NO: 25503 - RNA, 21 nt, Artificial Sequence
  Synthetic
uguucaaauuauuucuacugc

SEQ ID NO: 25504 - RNA, 22 nt, Artificial Sequence
  Synthetic
uuguucaaauuauuucuacugc

SEQ ID NO: 25505 - RNA, 23 nt, Artificial Sequence
  Synthetic
guuguucaaauuauuucuacugc

SEQ ID NO: 25506 - RNA, 24 nt, Artificial Sequence
  Synthetic
uguuguucaaauuauuucuacugc

SEQ ID NO: 25507 - RNA, 18 nt, Artificial Sequence
  Synthetic
auuugaacaaagacuugc

SEQ ID NO: 25508 - RNA, 19 nt, Artificial Sequence
  Synthetic
cauuugaacaaagacuugc

SEQ ID NO: 25509 - RNA, 21 nt, Artificial Sequence
  Synthetic
aacauuugaacaaagacuugc

SEQ ID NO: 25510 - RNA, 22 nt, Artificial Sequence
  Synthetic
uaacauuugaacaaagacuugc

SEQ ID NO: 25511 - RNA, 23 nt, Artificial Sequence
  Synthetic
guaacauuugaacaaagacuugc

SEQ ID NO: 25512 - RNA, 24 nt, Artificial Sequence
  Synthetic
gguaacauuugaacaaagacuugc

SEQ ID NO: 25513 - RNA, 18 nt, Artificial Sequence
  Synthetic
gaguuuacuaacucaauc

SEQ ID NO: 25514 - RNA, 19 nt, Artificial Sequence
  Synthetic
ggaguuuacuaacucaauc

SEQ ID NO: 25515 - RNA, 20 nt, Artificial Sequence
  Synthetic
cggaguuuacuaacucaauc

SEQ ID NO: 25516 - RNA, 21 nt, Artificial Sequence
  Synthetic
acggaguuuacuaacucaauc

SEQ ID NO: 25517 - RNA, 22 nt, Artificial Sequence
  Synthetic
aacggaguuuacuaacucaauc

SEQ ID NO: 25518 - RNA, 23 nt, Artificial Sequence
  Synthetic
aaacggaguuuacuaacucaauc

SEQ ID NO: 25519 - RNA, 24 nt, Artificial Sequence
  Synthetic
gaaacggaguuuacuaacucaauc

SEQ ID NO: 25520 - RNA, 18 nt, Artificial Sequence
  Synthetic
ucugcuggcaccuugauc

SEQ ID NO: 25521 - RNA, 19 nt, Artificial Sequence
  Synthetic
aucugcuggcaccuugauc

SEQ ID NO: 25522 - RNA, 20 nt, Artificial Sequence
  Synthetic
aaucugcuggcaccuugauc

SEQ ID NO: 25523 - RNA, 21 nt, Artificial Sequence
  Synthetic
aaaucugcuggcaccuugauc

SEQ ID NO: 25524 - RNA, 22 nt, Artificial Sequence
  Synthetic
caaaucugcuggcaccuugauc

SEQ ID NO: 25525 - RNA, 23 nt, Artificial Sequence
  Synthetic
ccaaaucugcuggcaccuugauc

SEQ ID NO: 25526 - RNA, 24 nt, Artificial Sequence
  Synthetic
cccaaaucugcuggcaccuugauc

SEQ ID NO: 25527 - RNA, 18 nt, Artificial Sequence
  Synthetic
cuugcuuuucccacuauc

SEQ ID NO: 25528 - RNA, 19 nt, Artificial Sequence
  Synthetic
ucuugcuuuucccacuauc

SEQ ID NO: 25529 - RNA, 20 nt, Artificial Sequence
  Synthetic
uucuugcuuuucccacuauc

SEQ ID NO: 25530 - RNA, 21 nt, Artificial Sequence
  Synthetic
cuucuugcuuuucccacuauc

SEQ ID NO: 25531 - RNA, 22 nt, Artificial Sequence
  Synthetic
gcuucuugcuuuucccacuauc

SEQ ID NO: 25532 - RNA, 23 nt, Artificial Sequence
  Synthetic
ugcuucuugcuuuucccacuauc

SEQ ID NO: 25533 - RNA, 24 nt, Artificial Sequence
  Synthetic
uugcuucuugcuuuucccacuauc

SEQ ID NO: 25534 - RNA, 18 nt, Artificial Sequence
  Synthetic
gugaaugaaugugguauc

SEQ ID NO: 25535 - RNA, 19 nt, Artificial Sequence
  Synthetic
agugaaugaaugugguauc

SEQ ID NO: 25536 - RNA, 20 nt, Artificial Sequence
  Synthetic
uagugaaugaaugugguauc

SEQ ID NO: 25537 - RNA, 21 nt, Artificial Sequence
  Synthetic
cuagugaaugaaugugguauc

SEQ ID NO: 25538 - RNA, 22 nt, Artificial Sequence
  Synthetic
gcuagugaaugaaugugguauc

SEQ ID NO: 25539 - RNA, 23 nt, Artificial Sequence
  Synthetic
agcuagugaaugaaugugguauc

SEQ ID NO: 25540 - RNA, 24 nt, Artificial Sequence
  Synthetic
aagcuagugaaugaaugugguauc

SEQ ID NO: 25541 - RNA, 18 nt, Artificial Sequence
  Synthetic
cacuguaaccuugaacuc

SEQ ID NO: 25542 - RNA, 19 nt, Artificial Sequence
  Synthetic
ucacuguaaccuugaacuc

SEQ ID NO: 25543 - RNA, 20 nt, Artificial Sequence
  Synthetic
cucacuguaaccuugaacuc

SEQ ID NO: 25544 - RNA, 21 nt, Artificial Sequence
  Synthetic
gcucacuguaaccuugaacuc

SEQ ID NO: 25545 - RNA, 22 nt, Artificial Sequence
  Synthetic
agcucacuguaaccuugaacuc

SEQ ID NO: 25546 - RNA, 23 nt, Artificial Sequence
  Synthetic
uagcucacuguaaccuugaacuc

SEQ ID NO: 25547 - RNA, 24 nt, Artificial Sequence
  Synthetic
auagcucacuguaaccuugaacuc

SEQ ID NO: 25548 - RNA, 18 nt, Artificial Sequence
  Synthetic
agaaauuaagaaagacuc

SEQ ID NO: 25549 - RNA, 19 nt, Artificial Sequence
  Synthetic
uagaaauuaagaaagacuc

SEQ ID NO: 25550 - RNA, 20 nt, Artificial Sequence
  Synthetic
auagaaauuaagaaagacuc

SEQ ID NO: 25551 - RNA, 21 nt, Artificial Sequence
  Synthetic
aauagaaauuaagaaagacuc

SEQ ID NO: 25552 - RNA, 22 nt, Artificial Sequence
  Synthetic
aaauagaaauuaagaaagacuc

SEQ ID NO: 25553 - RNA, 23 nt, Artificial Sequence
  Synthetic
aaaauagaaauuaagaaagacuc

SEQ ID NO: 25554 - RNA, 24 nt, Artificial Sequence
  Synthetic
gaaaauagaaauuaagaaagacuc

SEQ ID NO: 25555 - RNA, 18 nt, Artificial Sequence
  Synthetic
auuagggaaugcagacuc

SEQ ID NO: 25556 - RNA, 19 nt, Artificial Sequence
  Synthetic
gauuagggaaugcagacuc

SEQ ID NO: 25557 - RNA, 21 nt, Artificial Sequence
  Synthetic
gggauuagggaaugcagacuc

SEQ ID NO: 25558 - RNA, 22 nt, Artificial Sequence
  Synthetic
agggauuagggaaugcagacuc

SEQ ID NO: 25559 - RNA, 23 nt, Artificial Sequence
  Synthetic
gagggauuagggaaugcagacuc

SEQ ID NO: 25560 - RNA, 24 nt, Artificial Sequence
  Synthetic
ugagggauuagggaaugcagacuc

SEQ ID NO: 25561 - RNA, 18 nt, Artificial Sequence
  Synthetic
uauucuuuugauauacuc

SEQ ID NO: 25562 - RNA, 19 nt, Artificial Sequence
  Synthetic
uuauucuuuugauauacuc

SEQ ID NO: 25563 - RNA, 20 nt, Artificial Sequence
  Synthetic
cuuauucuuuugauauacuc

SEQ ID NO: 25564 - RNA, 21 nt, Artificial Sequence
  Synthetic
ccuuauucuuuugauauacuc

SEQ ID NO: 25565 - RNA, 22 nt, Artificial Sequence
  Synthetic
gccuuauucuuuugauauacuc

SEQ ID NO: 25566 - RNA, 23 nt, Artificial Sequence
  Synthetic
ugccuuauucuuuugauauacuc

SEQ ID NO: 25567 - RNA, 24 nt, Artificial Sequence
  Synthetic
augccuuauucuuuugauauacuc

SEQ ID NO: 25568 - RNA, 18 nt, Artificial Sequence
  Synthetic
ccguagucccagcuacuc

SEQ ID NO: 25569 - RNA, 19 nt, Artificial Sequence
  Synthetic
cccguagucccagcuacuc

SEQ ID NO: 25570 - RNA, 21 nt, Artificial Sequence
  Synthetic
ugcccguagucccagcuacuc

SEQ ID NO: 25571 - RNA, 22 nt, Artificial Sequence
  Synthetic
gugcccguagucccagcuacuc

SEQ ID NO: 25572 - RNA, 23 nt, Artificial Sequence
  Synthetic
ggugcccguagucccagcuacuc

SEQ ID NO: 25573 - RNA, 24 nt, Artificial Sequence
  Synthetic
gggugcccguagucccagcuacuc

SEQ ID NO: 25574 - RNA, 18 nt, Artificial Sequence
  Synthetic
cuuggacuucccagccuc

SEQ ID NO: 25575 - RNA, 19 nt, Artificial Sequence
  Synthetic
ucuuggacuucccagccuc

SEQ ID NO: 25576 - RNA, 20 nt, Artificial Sequence
  Synthetic
aucuuggacuucccagccuc

SEQ ID NO: 25577 - RNA, 21 nt, Artificial Sequence
  Synthetic
gaucuuggacuucccagccuc

SEQ ID NO: 25578 - RNA, 22 nt, Artificial Sequence
  Synthetic
ugaucuuggacuucccagccuc

SEQ ID NO: 25579 - RNA, 23 nt, Artificial Sequence
  Synthetic
uugaucuuggacuucccagccuc

SEQ ID NO: 25580 - RNA, 24 nt, Artificial Sequence
  Synthetic
cuugaucuuggacuucccagccuc

SEQ ID NO: 25581 - RNA, 18 nt, Artificial Sequence
  Synthetic
cacugcaaccucugccuc

SEQ ID NO: 25582 - RNA, 19 nt, Artificial Sequence
  Synthetic
ucacugcaaccucugccuc

SEQ ID NO: 25583 - RNA, 20 nt, Artificial Sequence
  Synthetic
cucacugcaaccucugccuc

SEQ ID NO: 25584 - RNA, 21 nt, Artificial Sequence
  Synthetic
gcucacugcaaccucugccuc

SEQ ID NO: 25585 - RNA, 22 nt, Artificial Sequence
  Synthetic
ggcucacugcaaccucugccuc

SEQ ID NO: 25586 - RNA, 23 nt, Artificial Sequence
  Synthetic
cggcucacugcaaccucugccuc

SEQ ID NO: 25587 - RNA, 24 nt, Artificial Sequence
  Synthetic
ucggcucacugcaaccucugccuc

SEQ ID NO: 25588 - RNA, 18 nt, Artificial Sequence
  Synthetic
aaaaaguuuaguggucuc

SEQ ID NO: 25589 - RNA, 19 nt, Artificial Sequence
  Synthetic
gaaaaaguuuaguggucuc

SEQ ID NO: 25590 - RNA, 20 nt, Artificial Sequence
  Synthetic
agaaaaaguuuaguggucuc

SEQ ID NO: 25591 - RNA, 21 nt, Artificial Sequence
  Synthetic
gagaaaaaguuuaguggucuc

SEQ ID NO: 25592 - RNA, 22 nt, Artificial Sequence
  Synthetic
ugagaaaaaguuuaguggucuc

SEQ ID NO: 25593 - RNA, 23 nt, Artificial Sequence
  Synthetic
gugagaaaaaguuuaguggucuc

SEQ ID NO: 25594 - RNA, 24 nt, Artificial Sequence
  Synthetic
ugugagaaaaaguuuaguggucuc

SEQ ID NO: 25595 - RNA, 18 nt, Artificial Sequence
  Synthetic
aggugaauugcuugaguc

SEQ ID NO: 25596 - RNA, 19 nt, Artificial Sequence
  Synthetic
caggugaauugcuugaguc

SEQ ID NO: 25597 - RNA, 20 nt, Artificial Sequence
  Synthetic
gcaggugaauugcuugaguc

SEQ ID NO: 25598 - RNA, 21 nt, Artificial Sequence
  Synthetic
ggcaggugaauugcuugaguc

SEQ ID NO: 25599 - RNA, 22 nt, Artificial Sequence
  Synthetic
aggcaggugaauugcuugaguc

SEQ ID NO: 25600 - RNA, 23 nt, Artificial Sequence
  Synthetic
gaggcaggugaauugcuugaguc

SEQ ID NO: 25601 - RNA, 24 nt, Artificial Sequence
  Synthetic
agaggcaggugaauugcuugaguc

SEQ ID NO: 25602 - RNA, 18 nt, Artificial Sequence
  Synthetic
uauguauauauguguguc

SEQ ID NO: 25603 - RNA, 19 nt, Artificial Sequence
  Synthetic
guauguauauauguguguc

SEQ ID NO: 25604 - RNA, 21 nt, Artificial Sequence
  Synthetic
auguauguauauauguguguc

SEQ ID NO: 25605 - RNA, 22 nt, Artificial Sequence
  Synthetic
uauguauguauauauguguguc

SEQ ID NO: 25606 - RNA, 23 nt, Artificial Sequence
  Synthetic
auauguauguauauauguguguc

SEQ ID NO: 25607 - RNA, 24 nt, Artificial Sequence
  Synthetic
cauauguauguauauauguguguc

SEQ ID NO: 25608 - RNA, 18 nt, Artificial Sequence
  Synthetic
gaccaaaacuuuauuguc

SEQ ID NO: 25609 - RNA, 19 nt, Artificial Sequence
  Synthetic
ggaccaaaacuuuauuguc

SEQ ID NO: 25610 - RNA, 21 nt, Artificial Sequence
  Synthetic
aaggaccaaaacuuuauuguc

SEQ ID NO: 25611 - RNA, 22 nt, Artificial Sequence
  Synthetic
aaaggaccaaaacuuuauuguc

SEQ ID NO: 25612 - RNA, 23 nt, Artificial Sequence
  Synthetic
aaaaggaccaaaacuuuauuguc

SEQ ID NO: 25613 - RNA, 24 nt, Artificial Sequence
  Synthetic
caaaaggaccaaaacuuuauuguc

SEQ ID NO: 25614 - RNA, 18 nt, Artificial Sequence
  Synthetic
cauuauaacacugcuuuc

SEQ ID NO: 25615 - RNA, 19 nt, Artificial Sequence
  Synthetic
ucauuauaacacugcuuuc

SEQ ID NO: 25616 - RNA, 21 nt, Artificial Sequence
  Synthetic
cuucauuauaacacugcuuuc

SEQ ID NO: 25617 - RNA, 22 nt, Artificial Sequence
  Synthetic
ucuucauuauaacacugcuuuc

SEQ ID NO: 25618 - RNA, 23 nt, Artificial Sequence
  Synthetic
cucuucauuauaacacugcuuuc

SEQ ID NO: 25619 - RNA, 24 nt, Artificial Sequence
  Synthetic
gcucuucauuauaacacugcuuuc

SEQ ID NO: 25620 - RNA, 18 nt, Artificial Sequence
  Synthetic
auguacaagucuaguuuc

SEQ ID NO: 25621 - RNA, 19 nt, Artificial Sequence
  Synthetic
gauguacaagucuaguuuc

SEQ ID NO: 25622 - RNA, 20 nt, Artificial Sequence
  Synthetic
ggauguacaagucuaguuuc

SEQ ID NO: 25623 - RNA, 21 nt, Artificial Sequence
  Synthetic
uggauguacaagucuaguuuc

SEQ ID NO: 25624 - RNA, 22 nt, Artificial Sequence
  Synthetic
uuggauguacaagucuaguuuc

SEQ ID NO: 25625 - RNA, 23 nt, Artificial Sequence
  Synthetic
guuggauguacaagucuaguuuc

SEQ ID NO: 25626 - RNA, 24 nt, Artificial Sequence
  Synthetic
aguuggauguacaagucuaguuuc

SEQ ID NO: 25627 - RNA, 18 nt, Artificial Sequence
  Synthetic
ggaaaauuuaacauuuuc

SEQ ID NO: 25628 - RNA, 19 nt, Artificial Sequence
  Synthetic
gggaaaauuuaacauuuuc

SEQ ID NO: 25629 - RNA, 20 nt, Artificial Sequence
  Synthetic
agggaaaauuuaacauuuuc

SEQ ID NO: 25630 - RNA, 21 nt, Artificial Sequence
  Synthetic
aagggaaaauuuaacauuuuc

SEQ ID NO: 25631 - RNA, 22 nt, Artificial Sequence
  Synthetic
uaagggaaaauuuaacauuuuc

SEQ ID NO: 25632 - RNA, 23 nt, Artificial Sequence
  Synthetic
cuaagggaaaauuuaacauuuuc

SEQ ID NO: 25633 - RNA, 24 nt, Artificial Sequence
  Synthetic
ccuaagggaaaauuuaacauuuuc

SEQ ID NO: 25634 - RNA, 18 nt, Artificial Sequence
  Synthetic
uuccauuacauuguuuuc

SEQ ID NO: 25635 - RNA, 19 nt, Artificial Sequence
  Synthetic
uuuccauuacauuguuuuc

SEQ ID NO: 25636 - RNA, 20 nt, Artificial Sequence
  Synthetic
guuuccauuacauuguuuuc

SEQ ID NO: 25637 - RNA, 21 nt, Artificial Sequence
  Synthetic
uguuuccauuacauuguuuuc

SEQ ID NO: 25638 - RNA, 22 nt, Artificial Sequence
  Synthetic
guguuuccauuacauuguuuuc

SEQ ID NO: 25639 - RNA, 23 nt, Artificial Sequence
  Synthetic
aguguuuccauuacauuguuuuc

SEQ ID NO: 25640 - RNA, 24 nt, Artificial Sequence
  Synthetic
uaguguuuccauuacauuguuuuc

SEQ ID NO: 25641 - RNA, 18 nt, Artificial Sequence
  Synthetic
auuaaaauauauaaaaag

SEQ ID NO: 25642 - RNA, 19 nt, Artificial Sequence
  Synthetic
aauuaaaauauauaaaaag

SEQ ID NO: 25643 - RNA, 20 nt, Artificial Sequence
  Synthetic
aaauuaaaauauauaaaaag

SEQ ID NO: 25644 - RNA, 21 nt, Artificial Sequence
  Synthetic
aaaauuaaaauauauaaaaag

SEQ ID NO: 25645 - RNA, 22 nt, Artificial Sequence
  Synthetic
gaaaauuaaaauauauaaaaag

SEQ ID NO: 25646 - RNA, 23 nt, Artificial Sequence
  Synthetic
ugaaaauuaaaauauauaaaaag

SEQ ID NO: 25647 - RNA, 24 nt, Artificial Sequence
  Synthetic
augaaaauuaaaauauauaaaaag

SEQ ID NO: 25648 - RNA, 18 nt, Artificial Sequence
  Synthetic
agagaggaaggaagaaag

SEQ ID NO: 25649 - RNA, 19 nt, Artificial Sequence
  Synthetic
aagagaggaaggaagaaag

SEQ ID NO: 25650 - RNA, 20 nt, Artificial Sequence
  Synthetic
aaagagaggaaggaagaaag

SEQ ID NO: 25651 - RNA, 21 nt, Artificial Sequence
  Synthetic
gaaagagaggaaggaagaaag

SEQ ID NO: 25652 - RNA, 22 nt, Artificial Sequence
  Synthetic
agaaagagaggaaggaagaaag

SEQ ID NO: 25653 - RNA, 23 nt, Artificial Sequence
  Synthetic
aagaaagagaggaaggaagaaag

SEQ ID NO: 25654 - RNA, 24 nt, Artificial Sequence
  Synthetic
aaagaaagagaggaaggaagaaag

SEQ ID NO: 25655 - RNA, 18 nt, Artificial Sequence
  Synthetic
ggaaggaaggaaggaaag

SEQ ID NO: 25656 - RNA, 19 nt, Artificial Sequence
  Synthetic
aggaaggaaggaaggaaag

SEQ ID NO: 25657 - RNA, 20 nt, Artificial Sequence
  Synthetic
gaggaaggaaggaaggaaag

SEQ ID NO: 25658 - RNA, 21 nt, Artificial Sequence
  Synthetic
ggaggaaggaaggaaggaaag

SEQ ID NO: 25659 - RNA, 22 nt, Artificial Sequence
  Synthetic
aggaggaaggaaggaaggaaag

SEQ ID NO: 25660 - RNA, 23 nt, Artificial Sequence
  Synthetic
uaggaggaaggaaggaaggaaag

SEQ ID NO: 25661 - RNA, 24 nt, Artificial Sequence
  Synthetic
guaggaggaaggaaggaaggaaag

SEQ ID NO: 25662 - RNA, 18 nt, Artificial Sequence
  Synthetic
aacccaacugaugucaag

SEQ ID NO: 25663 - RNA, 19 nt, Artificial Sequence
  Synthetic
gaacccaacugaugucaag

SEQ ID NO: 25664 - RNA, 20 nt, Artificial Sequence
  Synthetic
ggaacccaacugaugucaag

SEQ ID NO: 25665 - RNA, 21 nt, Artificial Sequence
  Synthetic
cggaacccaacugaugucaag

SEQ ID NO: 25666 - RNA, 22 nt, Artificial Sequence
  Synthetic
ccggaacccaacugaugucaag

SEQ ID NO: 25667 - RNA, 23 nt, Artificial Sequence
  Synthetic
cccggaacccaacugaugucaag

SEQ ID NO: 25668 - RNA, 24 nt, Artificial Sequence
  Synthetic
ucccggaacccaacugaugucaag

SEQ ID NO: 25669 - RNA, 18 nt, Artificial Sequence
  Synthetic
ucaccugagccugagaag

SEQ ID NO: 25670 - RNA, 19 nt, Artificial Sequence
  Synthetic
aucaccugagccugagaag

SEQ ID NO: 25671 - RNA, 21 nt, Artificial Sequence
  Synthetic
ggaucaccugagccugagaag

SEQ ID NO: 25672 - RNA, 22 nt, Artificial Sequence
  Synthetic
aggaucaccugagccugagaag

SEQ ID NO: 25673 - RNA, 23 nt, Artificial Sequence
  Synthetic
gaggaucaccugagccugagaag

SEQ ID NO: 25674 - RNA, 24 nt, Artificial Sequence
  Synthetic
ggaggaucaccugagccugagaag

SEQ ID NO: 25675 - RNA, 18 nt, Artificial Sequence
  Synthetic
aaugaggaagaaaggaag

SEQ ID NO: 25676 - RNA, 19 nt, Artificial Sequence
  Synthetic
aaaugaggaagaaaggaag

SEQ ID NO: 25677 - RNA, 20 nt, Artificial Sequence
  Synthetic
gaaaugaggaagaaaggaag

SEQ ID NO: 25678 - RNA, 21 nt, Artificial Sequence
  Synthetic
ggaaaugaggaagaaaggaag

SEQ ID NO: 25679 - RNA, 22 nt, Artificial Sequence
  Synthetic
aggaaaugaggaagaaaggaag

SEQ ID NO: 25680 - RNA, 23 nt, Artificial Sequence
  Synthetic
aaggaaaugaggaagaaaggaag

SEQ ID NO: 25681 - RNA, 24 nt, Artificial Sequence
  Synthetic
gaaggaaaugaggaagaaaggaag

SEQ ID NO: 25682 - RNA, 18 nt, Artificial Sequence
  Synthetic
agucuaguuucaaggaag

SEQ ID NO: 25683 - RNA, 19 nt, Artificial Sequence
  Synthetic
aagucuaguuucaaggaag

SEQ ID NO: 25684 - RNA, 21 nt, Artificial Sequence
  Synthetic
acaagucuaguuucaaggaag

SEQ ID NO: 25685 - RNA, 22 nt, Artificial Sequence
  Synthetic
uacaagucuaguuucaaggaag

SEQ ID NO: 25686 - RNA, 23 nt, Artificial Sequence
  Synthetic
guacaagucuaguuucaaggaag

SEQ ID NO: 25687 - RNA, 24 nt, Artificial Sequence
  Synthetic
uguacaagucuaguuucaaggaag

SEQ ID NO: 25688 - RNA, 18 nt, Artificial Sequence
  Synthetic
ggggcugguagugugaag

SEQ ID NO: 25689 - RNA, 19 nt, Artificial Sequence
  Synthetic
gggggcugguagugugaag

SEQ ID NO: 25690 - RNA, 20 nt, Artificial Sequence
  Synthetic
agggggcugguagugugaag

SEQ ID NO: 25691 - RNA, 21 nt, Artificial Sequence
  Synthetic
gagggggcugguagugugaag

SEQ ID NO: 25692 - RNA, 22 nt, Artificial Sequence
  Synthetic
agagggggcugguagugugaag

SEQ ID NO: 25693 - RNA, 23 nt, Artificial Sequence
  Synthetic
aagagggggcugguagugugaag

SEQ ID NO: 25694 - RNA, 24 nt, Artificial Sequence
  Synthetic
gaagagggggcugguagugugaag

SEQ ID NO: 25695 - RNA, 18 nt, Artificial Sequence
  Synthetic
gaaauuagaaagaauaag

SEQ ID NO: 25696 - RNA, 19 nt, Artificial Sequence
  Synthetic
ugaaauuagaaagaauaag

SEQ ID NO: 25697 - RNA, 21 nt, Artificial Sequence
  Synthetic
aaugaaauuagaaagaauaag

SEQ ID NO: 25698 - RNA, 22 nt, Artificial Sequence
  Synthetic
gaaugaaauuagaaagaauaag

SEQ ID NO: 25699 - RNA, 23 nt, Artificial Sequence
  Synthetic
agaaugaaauuagaaagaauaag

SEQ ID NO: 25700 - RNA, 24 nt, Artificial Sequence
  Synthetic
cagaaugaaauuagaaagaauaag

SEQ ID NO: 25701 - RNA, 18 nt, Artificial Sequence
  Synthetic
auaggauuaauggauaag

SEQ ID NO: 25702 - RNA, 19 nt, Artificial Sequence
  Synthetic
aauaggauuaauggauaag

SEQ ID NO: 25703 - RNA, 20 nt, Artificial Sequence
  Synthetic
caauaggauuaauggauaag

SEQ ID NO: 25704 - RNA, 21 nt, Artificial Sequence
  Synthetic
ccaauaggauuaauggauaag

SEQ ID NO: 25705 - RNA, 22 nt, Artificial Sequence
  Synthetic
uccaauaggauuaauggauaag

SEQ ID NO: 25706 - RNA, 23 nt, Artificial Sequence
  Synthetic
auccaauaggauuaauggauaag

SEQ ID NO: 25707 - RNA, 24 nt, Artificial Sequence
  Synthetic
gauccaauaggauuaauggauaag

SEQ ID NO: 25708 - RNA, 18 nt, Artificial Sequence
  Synthetic
ggaaagaggguugauaag

SEQ ID NO: 25709 - RNA, 19 nt, Artificial Sequence
  Synthetic
aggaaagaggguugauaag

SEQ ID NO: 25710 - RNA, 20 nt, Artificial Sequence
  Synthetic
aaggaaagaggguugauaag

SEQ ID NO: 25711 - RNA, 21 nt, Artificial Sequence
  Synthetic
aaaggaaagaggguugauaag

SEQ ID NO: 25712 - RNA, 22 nt, Artificial Sequence
  Synthetic
uaaaggaaagaggguugauaag

SEQ ID NO: 25713 - RNA, 23 nt, Artificial Sequence
  Synthetic
cuaaaggaaagaggguugauaag

SEQ ID NO: 25714 - RNA, 24 nt, Artificial Sequence
  Synthetic
ucuaaaggaaagaggguugauaag

SEQ ID NO: 25715 - RNA, 18 nt, Artificial Sequence
  Synthetic
uauuuaucaauaucuaag

SEQ ID NO: 25716 - RNA, 19 nt, Artificial Sequence
  Synthetic
uuauuuaucaauaucuaag

SEQ ID NO: 25717 - RNA, 20 nt, Artificial Sequence
  Synthetic
auuauuuaucaauaucuaag

SEQ ID NO: 25718 - RNA, 21 nt, Artificial Sequence
  Synthetic
aauuauuuaucaauaucuaag

SEQ ID NO: 25719 - RNA, 22 nt, Artificial Sequence
  Synthetic
caauuauuuaucaauaucuaag

SEQ ID NO: 25720 - RNA, 23 nt, Artificial Sequence
  Synthetic
gcaauuauuuaucaauaucuaag

SEQ ID NO: 25721 - RNA, 24 nt, Artificial Sequence
  Synthetic
ggcaauuauuuaucaauaucuaag

SEQ ID NO: 25722 - RNA, 18 nt, Artificial Sequence
  Synthetic
gcucauucaucaaguaag

SEQ ID NO: 25723 - RNA, 19 nt, Artificial Sequence
  Synthetic
ugcucauucaucaaguaag

SEQ ID NO: 25724 - RNA, 20 nt, Artificial Sequence
  Synthetic
augcucauucaucaaguaag

SEQ ID NO: 25725 - RNA, 21 nt, Artificial Sequence
  Synthetic
aaugcucauucaucaaguaag

SEQ ID NO: 25726 - RNA, 22 nt, Artificial Sequence
  Synthetic
aaaugcucauucaucaaguaag

SEQ ID NO: 25727 - RNA, 23 nt, Artificial Sequence
  Synthetic
caaaugcucauucaucaaguaag

SEQ ID NO: 25728 - RNA, 24 nt, Artificial Sequence
  Synthetic
ucaaaugcucauucaucaaguaag

SEQ ID NO: 25729 - RNA, 18 nt, Artificial Sequence
  Synthetic
aagaaggaaggaaguaag

SEQ ID NO: 25730 - RNA, 19 nt, Artificial Sequence
  Synthetic
aaagaaggaaggaaguaag

SEQ ID NO: 25731 - RNA, 21 nt, Artificial Sequence
  Synthetic
ggaaagaaggaaggaaguaag

SEQ ID NO: 25732 - RNA, 22 nt, Artificial Sequence
  Synthetic
aggaaagaaggaaggaaguaag

SEQ ID NO: 25733 - RNA, 23 nt, Artificial Sequence
  Synthetic
aaggaaagaaggaaggaaguaag

SEQ ID NO: 25734 - RNA, 24 nt, Artificial Sequence
  Synthetic
gaaggaaagaaggaaggaaguaag

SEQ ID NO: 25735 - RNA, 18 nt, Artificial Sequence
  Synthetic
ugccaugugagaacacag

SEQ ID NO: 25736 - RNA, 19 nt, Artificial Sequence
  Synthetic
cugccaugugagaacacag

SEQ ID NO: 25737 - RNA, 20 nt, Artificial Sequence
  Synthetic
ucugccaugugagaacacag

SEQ ID NO: 25738 - RNA, 21 nt, Artificial Sequence
  Synthetic
uucugccaugugagaacacag

SEQ ID NO: 25739 - RNA, 22 nt, Artificial Sequence
  Synthetic
uuucugccaugugagaacacag

SEQ ID NO: 25740 - RNA, 23 nt, Artificial Sequence
  Synthetic
cuuucugccaugugagaacacag

SEQ ID NO: 25741 - RNA, 24 nt, Artificial Sequence
  Synthetic
ccuuucugccaugugagaacacag

SEQ ID NO: 25742 - RNA, 18 nt, Artificial Sequence
  Synthetic
auuucaacuuauacacag

SEQ ID NO: 25743 - RNA, 19 nt, Artificial Sequence
  Synthetic
cauuucaacuuauacacag

SEQ ID NO: 25744 - RNA, 20 nt, Artificial Sequence
  Synthetic
ucauuucaacuuauacacag

SEQ ID NO: 25745 - RNA, 21 nt, Artificial Sequence
  Synthetic
aucauuucaacuuauacacag

SEQ ID NO: 25746 - RNA, 22 nt, Artificial Sequence
  Synthetic
uaucauuucaacuuauacacag

SEQ ID NO: 25747 - RNA, 23 nt, Artificial Sequence
  Synthetic
auaucauuucaacuuauacacag

SEQ ID NO: 25748 - RNA, 24 nt, Artificial Sequence
  Synthetic
aauaucauuucaacuuauacacag

SEQ ID NO: 25749 - RNA, 18 nt, Artificial Sequence
  Synthetic
cuguugucugcaucacag

SEQ ID NO: 25750 - RNA, 19 nt, Artificial Sequence
  Synthetic
ucuguugucugcaucacag

SEQ ID NO: 25751 - RNA, 20 nt, Artificial Sequence
  Synthetic
uucuguugucugcaucacag

SEQ ID NO: 25752 - RNA, 21 nt, Artificial Sequence
  Synthetic
cuucuguugucugcaucacag

SEQ ID NO: 25753 - RNA, 22 nt, Artificial Sequence
  Synthetic
ccuucuguugucugcaucacag

SEQ ID NO: 25754 - RNA, 23 nt, Artificial Sequence
  Synthetic
uccuucuguugucugcaucacag

SEQ ID NO: 25755 - RNA, 24 nt, Artificial Sequence
  Synthetic
guccuucuguugucugcaucacag

SEQ ID NO: 25756 - RNA, 18 nt, Artificial Sequence
  Synthetic
gagucuuccaaguagcag

SEQ ID NO: 25757 - RNA, 19 nt, Artificial Sequence
  Synthetic
agagucuuccaaguagcag

SEQ ID NO: 25758 - RNA, 20 nt, Artificial Sequence
  Synthetic
aagagucuuccaaguagcag

SEQ ID NO: 25759 - RNA, 21 nt, Artificial Sequence
  Synthetic
gaagagucuuccaaguagcag

SEQ ID NO: 25760 - RNA, 22 nt, Artificial Sequence
  Synthetic
ggaagagucuuccaaguagcag

SEQ ID NO: 25761 - RNA, 23 nt, Artificial Sequence
  Synthetic
gggaagagucuuccaaguagcag

SEQ ID NO: 25762 - RNA, 24 nt, Artificial Sequence
  Synthetic
ugggaagagucuuccaaguagcag

SEQ ID NO: 25763 - RNA, 18 nt, Artificial Sequence
  Synthetic
ccaaaacuuuauugucag

SEQ ID NO: 25764 - RNA, 19 nt, Artificial Sequence
  Synthetic
accaaaacuuuauugucag

SEQ ID NO: 25765 - RNA, 20 nt, Artificial Sequence
  Synthetic
gaccaaaacuuuauugucag

SEQ ID NO: 25766 - RNA, 21 nt, Artificial Sequence
  Synthetic
ggaccaaaacuuuauugucag

SEQ ID NO: 25767 - RNA, 22 nt, Artificial Sequence
  Synthetic
aggaccaaaacuuuauugucag

SEQ ID NO: 25768 - RNA, 23 nt, Artificial Sequence
  Synthetic
aaggaccaaaacuuuauugucag

SEQ ID NO: 25769 - RNA, 24 nt, Artificial Sequence
  Synthetic
aaaggaccaaaacuuuauugucag

SEQ ID NO: 25770 - RNA, 18 nt, Artificial Sequence
  Synthetic
caagugcaaagcuuucag

SEQ ID NO: 25771 - RNA, 19 nt, Artificial Sequence
  Synthetic
gcaagugcaaagcuuucag

SEQ ID NO: 25772 - RNA, 20 nt, Artificial Sequence
  Synthetic
agcaagugcaaagcuuucag

SEQ ID NO: 25773 - RNA, 21 nt, Artificial Sequence
  Synthetic
aagcaagugcaaagcuuucag

SEQ ID NO: 25774 - RNA, 22 nt, Artificial Sequence
  Synthetic
gaagcaagugcaaagcuuucag

SEQ ID NO: 25775 - RNA, 23 nt, Artificial Sequence
  Synthetic
ugaagcaagugcaaagcuuucag

SEQ ID NO: 25776 - RNA, 24 nt, Artificial Sequence
  Synthetic
gugaagcaagugcaaagcuuucag

SEQ ID NO: 25777 - RNA, 18 nt, Artificial Sequence
  Synthetic
aaacagaaaaagaaagag

SEQ ID NO: 25778 - RNA, 19 nt, Artificial Sequence
  Synthetic
caaacagaaaaagaaagag

SEQ ID NO: 25779 - RNA, 21 nt, Artificial Sequence
  Synthetic
gacaaacagaaaaagaaagag

SEQ ID NO: 25780 - RNA, 22 nt, Artificial Sequence
  Synthetic
agacaaacagaaaaagaaagag

SEQ ID NO: 25781 - RNA, 23 nt, Artificial Sequence
  Synthetic
aagacaaacagaaaaagaaagag

SEQ ID NO: 25782 - RNA, 24 nt, Artificial Sequence
  Synthetic
uaagacaaacagaaaaagaaagag

SEQ ID NO: 25783 - RNA, 21 nt, Artificial Sequence
  Synthetic
auuuuuguauuuuuaguagag

SEQ ID NO: 25784 - RNA, 22 nt, Artificial Sequence
  Synthetic
aauuuuuguauuuuuaguagag

SEQ ID NO: 25785 - RNA, 23 nt, Artificial Sequence
  Synthetic
uaauuuuuguauuuuuaguagag

SEQ ID NO: 25786 - RNA, 24 nt, Artificial Sequence
  Synthetic
cuaauuuuuguauuuuuaguagag

SEQ ID NO: 25787 - RNA, 18 nt, Artificial Sequence
  Synthetic
gaaagaaucaaauuagag

SEQ ID NO: 25788 - RNA, 19 nt, Artificial Sequence
  Synthetic
ugaaagaaucaaauuagag

SEQ ID NO: 25789 - RNA, 20 nt, Artificial Sequence
  Synthetic
augaaagaaucaaauuagag

SEQ ID NO: 25790 - RNA, 21 nt, Artificial Sequence
  Synthetic
caugaaagaaucaaauuagag

SEQ ID NO: 25791 - RNA, 22 nt, Artificial Sequence
  Synthetic
acaugaaagaaucaaauuagag

SEQ ID NO: 25792 - RNA, 23 nt, Artificial Sequence
  Synthetic
gacaugaaagaaucaaauuagag

SEQ ID NO: 25793 - RNA, 24 nt, Artificial Sequence
  Synthetic
agacaugaaagaaucaaauuagag

SEQ ID NO: 25794 - RNA, 18 nt, Artificial Sequence
  Synthetic
aacaaagacuugcaggag

SEQ ID NO: 25795 - RNA, 19 nt, Artificial Sequence
  Synthetic
gaacaaagacuugcaggag

SEQ ID NO: 25796 - RNA, 20 nt, Artificial Sequence
  Synthetic
ugaacaaagacuugcaggag

SEQ ID NO: 25797 - RNA, 21 nt, Artificial Sequence
  Synthetic
uugaacaaagacuugcaggag

SEQ ID NO: 25798 - RNA, 22 nt, Artificial Sequence
  Synthetic
uuugaacaaagacuugcaggag

SEQ ID NO: 25799 - RNA, 23 nt, Artificial Sequence
  Synthetic
auuugaacaaagacuugcaggag

SEQ ID NO: 25800 - RNA, 24 nt, Artificial Sequence
  Synthetic
cauuugaacaaagacuugcaggag

SEQ ID NO: 25801 - RNA, 18 nt, Artificial Sequence
  Synthetic
aucaauaucuaagaugag

SEQ ID NO: 25802 - RNA, 19 nt, Artificial Sequence
  Synthetic
uaucaauaucuaagaugag

SEQ ID NO: 25803 - RNA, 20 nt, Artificial Sequence
  Synthetic
uuaucaauaucuaagaugag

SEQ ID NO: 25804 - RNA, 21 nt, Artificial Sequence
  Synthetic
uuuaucaauaucuaagaugag

SEQ ID NO: 25805 - RNA, 22 nt, Artificial Sequence
  Synthetic
auuuaucaauaucuaagaugag

SEQ ID NO: 25806 - RNA, 23 nt, Artificial Sequence
  Synthetic
uauuuaucaauaucuaagaugag

SEQ ID NO: 25807 - RNA, 24 nt, Artificial Sequence
  Synthetic
uuauuuaucaauaucuaagaugag

SEQ ID NO: 25808 - RNA, 18 nt, Artificial Sequence
  Synthetic
gcuacuugggaggcugag

SEQ ID NO: 25809 - RNA, 19 nt, Artificial Sequence
  Synthetic
agcuacuugggaggcugag

SEQ ID NO: 25810 - RNA, 20 nt, Artificial Sequence
  Synthetic
cagcuacuugggaggcugag

SEQ ID NO: 25811 - RNA, 21 nt, Artificial Sequence
  Synthetic
ccagcuacuugggaggcugag

SEQ ID NO: 25812 - RNA, 22 nt, Artificial Sequence
  Synthetic
cccagcuacuugggaggcugag

SEQ ID NO: 25813 - RNA, 23 nt, Artificial Sequence
  Synthetic
ucccagcuacuugggaggcugag

SEQ ID NO: 25814 - RNA, 24 nt, Artificial Sequence
  Synthetic
gucccagcuacuugggaggcugag

SEQ ID NO: 25815 - RNA, 18 nt, Artificial Sequence
  Synthetic
ggcagaacuugcagugag

SEQ ID NO: 25816 - RNA, 19 nt, Artificial Sequence
  Synthetic
aggcagaacuugcagugag

SEQ ID NO: 25817 - RNA, 20 nt, Artificial Sequence
  Synthetic
gaggcagaacuugcagugag

SEQ ID NO: 25818 - RNA, 21 nt, Artificial Sequence
  Synthetic
ggaggcagaacuugcagugag

SEQ ID NO: 25819 - RNA, 22 nt, Artificial Sequence
  Synthetic
aggaggcagaacuugcagugag

SEQ ID NO: 25820 - RNA, 23 nt, Artificial Sequence
  Synthetic
caggaggcagaacuugcagugag

SEQ ID NO: 25821 - RNA, 24 nt, Artificial Sequence
  Synthetic
ccaggaggcagaacuugcagugag

SEQ ID NO: 25822 - RNA, 18 nt, Artificial Sequence
  Synthetic
uuuuuuuuuuuuuuugag

SEQ ID NO: 25823 - RNA, 19 nt, Artificial Sequence
  Synthetic
uuuuuuuuuuuuuuuugag

SEQ ID NO: 25824 - RNA, 20 nt, Artificial Sequence
  Synthetic
uuuuuuuuuuuuuuuuugag

SEQ ID NO: 25825 - RNA, 21 nt, Artificial Sequence
  Synthetic
uuuuuuuuuuuuuuuuuugag

SEQ ID NO: 25826 - RNA, 22 nt, Artificial Sequence
  Synthetic
uuuuuuuuuuuuuuuuuuugag

SEQ ID NO: 25827 - RNA, 23 nt, Artificial Sequence
  Synthetic
uuuuuuuuuuuuuuuuuuuugag

SEQ ID NO: 25828 - RNA, 24 nt, Artificial Sequence
  Synthetic
uuuuuuuuuuuuuuuuuuuuugag

SEQ ID NO: 25829 - RNA, 18 nt, Artificial Sequence
  Synthetic
gcuuuuaaaacaaaauag

SEQ ID NO: 25830 - RNA, 19 nt, Artificial Sequence
  Synthetic
agcuuuuaaaacaaaauag

SEQ ID NO: 25831 - RNA, 20 nt, Artificial Sequence
  Synthetic
cagcuuuuaaaacaaaauag

SEQ ID NO: 25832 - RNA, 21 nt, Artificial Sequence
  Synthetic
acagcuuuuaaaacaaaauag

SEQ ID NO: 25833 - RNA, 22 nt, Artificial Sequence
  Synthetic
aacagcuuuuaaaacaaaauag

SEQ ID NO: 25834 - RNA, 23 nt, Artificial Sequence
  Synthetic
aaacagcuuuuaaaacaaaauag

SEQ ID NO: 25835 - RNA, 24 nt, Artificial Sequence
  Synthetic
gaaacagcuuuuaaaacaaaauag

SEQ ID NO: 25836 - RNA, 18 nt, Artificial Sequence
  Synthetic
acuuaaugaaagcaauag

SEQ ID NO: 25837 - RNA, 19 nt, Artificial Sequence
  Synthetic
gacuuaaugaaagcaauag

SEQ ID NO: 25838 - RNA, 20 nt, Artificial Sequence
  Synthetic
ugacuuaaugaaagcaauag

SEQ ID NO: 25839 - RNA, 21 nt, Artificial Sequence
  Synthetic
gugacuuaaugaaagcaauag

SEQ ID NO: 25840 - RNA, 22 nt, Artificial Sequence
  Synthetic
cgugacuuaaugaaagcaauag

SEQ ID NO: 25841 - RNA, 23 nt, Artificial Sequence
  Synthetic
ucgugacuuaaugaaagcaauag

SEQ ID NO: 25842 - RNA, 24 nt, Artificial Sequence
  Synthetic
cucgugacuuaaugaaagcaauag

SEQ ID NO: 25843 - RNA, 18 nt, Artificial Sequence
  Synthetic
uaaaaaauuauacuauag

SEQ ID NO: 25844 - RNA, 19 nt, Artificial Sequence
  Synthetic
uuaaaaaauuauacuauag

SEQ ID NO: 25845 - RNA, 20 nt, Artificial Sequence
  Synthetic
auuaaaaaauuauacuauag

SEQ ID NO: 25846 - RNA, 21 nt, Artificial Sequence
  Synthetic
uauuaaaaaauuauacuauag

SEQ ID NO: 25847 - RNA, 22 nt, Artificial Sequence
  Synthetic
cuauuaaaaaauuauacuauag

SEQ ID NO: 25848 - RNA, 23 nt, Artificial Sequence
  Synthetic
acuauuaaaaaauuauacuauag

SEQ ID NO: 25849 - RNA, 24 nt, Artificial Sequence
  Synthetic
cacuauuaaaaaauuauacuauag

SEQ ID NO: 25850 - RNA, 18 nt, Artificial Sequence
  Synthetic
guaguggaaguaguauag

SEQ ID NO: 25851 - RNA, 19 nt, Artificial Sequence
  Synthetic
aguaguggaaguaguauag

SEQ ID NO: 25852 - RNA, 20 nt, Artificial Sequence
  Synthetic
uaguaguggaaguaguauag

SEQ ID NO: 25853 - RNA, 21 nt, Artificial Sequence
  Synthetic
guaguaguggaaguaguauag

SEQ ID NO: 25854 - RNA, 22 nt, Artificial Sequence
  Synthetic
gguaguaguggaaguaguauag

SEQ ID NO: 25855 - RNA, 23 nt, Artificial Sequence
  Synthetic
agguaguaguggaaguaguauag

SEQ ID NO: 25856 - RNA, 24 nt, Artificial Sequence
  Synthetic
cagguaguaguggaaguaguauag

SEQ ID NO: 25857 - RNA, 18 nt, Artificial Sequence
  Synthetic
ccucacccucccaaguag

SEQ ID NO: 25858 - RNA, 19 nt, Artificial Sequence
  Synthetic
gccucacccucccaaguag

SEQ ID NO: 25859 - RNA, 20 nt, Artificial Sequence
  Synthetic
ugccucacccucccaaguag

SEQ ID NO: 25860 - RNA, 21 nt, Artificial Sequence
  Synthetic
cugccucacccucccaaguag

SEQ ID NO: 25861 - RNA, 22 nt, Artificial Sequence
  Synthetic
ccugccucacccucccaaguag

SEQ ID NO: 25862 - RNA, 23 nt, Artificial Sequence
  Synthetic
uccugccucacccucccaaguag

SEQ ID NO: 25863 - RNA, 24 nt, Artificial Sequence
  Synthetic
cuccugccucacccucccaaguag

SEQ ID NO: 25864 - RNA, 19 nt, Artificial Sequence
  Synthetic
gccucagccucccaaguag

SEQ ID NO: 25865 - RNA, 20 nt, Artificial Sequence
  Synthetic
ugccucagccucccaaguag

SEQ ID NO: 25866 - RNA, 21 nt, Artificial Sequence
  Synthetic
cugccucagccucccaaguag

SEQ ID NO: 25867 - RNA, 22 nt, Artificial Sequence
  Synthetic
ccugccucagccucccaaguag

SEQ ID NO: 25868 - RNA, 23 nt, Artificial Sequence
  Synthetic
uccugccucagccucccaaguag

SEQ ID NO: 25869 - RNA, 24 nt, Artificial Sequence
  Synthetic
cuccugccucagccucccaaguag

SEQ ID NO: 25870 - RNA, 18 nt, Artificial Sequence
  Synthetic
gaggaagaaaggaaguag

SEQ ID NO: 25871 - RNA, 19 nt, Artificial Sequence
  Synthetic
ugaggaagaaaggaaguag

SEQ ID NO: 25872 - RNA, 20 nt, Artificial Sequence
  Synthetic
augaggaagaaaggaaguag

SEQ ID NO: 25873 - RNA, 21 nt, Artificial Sequence
  Synthetic
aaugaggaagaaaggaaguag

SEQ ID NO: 25874 - RNA, 22 nt, Artificial Sequence
  Synthetic
aaaugaggaagaaaggaaguag

SEQ ID NO: 25875 - RNA, 23 nt, Artificial Sequence
  Synthetic
gaaaugaggaagaaaggaaguag

SEQ ID NO: 25876 - RNA, 24 nt, Artificial Sequence
  Synthetic
ggaaaugaggaagaaaggaaguag

SEQ ID NO: 25877 - RNA, 18 nt, Artificial Sequence
  Synthetic
gcuugauccagguaguag

SEQ ID NO: 25878 - RNA, 19 nt, Artificial Sequence
  Synthetic
ggcuugauccagguaguag

SEQ ID NO: 25879 - RNA, 21 nt, Artificial Sequence
  Synthetic
guggcuugauccagguaguag

SEQ ID NO: 25880 - RNA, 22 nt, Artificial Sequence
  Synthetic
gguggcuugauccagguaguag

SEQ ID NO: 25881 - RNA, 23 nt, Artificial Sequence
  Synthetic
ugguggcuugauccagguaguag

SEQ ID NO: 25882 - RNA, 24 nt, Artificial Sequence
  Synthetic
augguggcuugauccagguaguag

SEQ ID NO: 25883 - RNA, 18 nt, Artificial Sequence
  Synthetic
cuaugaaggcagaguuag

SEQ ID NO: 25884 - RNA, 19 nt, Artificial Sequence
  Synthetic
gcuaugaaggcagaguuag

SEQ ID NO: 25885 - RNA, 21 nt, Artificial Sequence
  Synthetic
cagcuaugaaggcagaguuag

SEQ ID NO: 25886 - RNA, 22 nt, Artificial Sequence
  Synthetic
gcagcuaugaaggcagaguuag

SEQ ID NO: 25887 - RNA, 23 nt, Artificial Sequence
  Synthetic
agcagcuaugaaggcagaguuag

SEQ ID NO: 25888 - RNA, 24 nt, Artificial Sequence
  Synthetic
aagcagcuaugaaggcagaguuag

SEQ ID NO: 25889 - RNA, 18 nt, Artificial Sequence
  Synthetic
gggguuucaccguuuuag

SEQ ID NO: 25890 - RNA, 19 nt, Artificial Sequence
  Synthetic
cgggguuucaccguuuuag

SEQ ID NO: 25891 - RNA, 20 nt, Artificial Sequence
  Synthetic
acgggguuucaccguuuuag

SEQ ID NO: 25892 - RNA, 21 nt, Artificial Sequence
  Synthetic
gacgggguuucaccguuuuag

SEQ ID NO: 25893 - RNA, 22 nt, Artificial Sequence
  Synthetic
agacgggguuucaccguuuuag

SEQ ID NO: 25894 - RNA, 23 nt, Artificial Sequence
  Synthetic
gagacgggguuucaccguuuuag

SEQ ID NO: 25895 - RNA, 24 nt, Artificial Sequence
  Synthetic
agagacgggguuucaccguuuuag

SEQ ID NO: 25896 - RNA, 18 nt, Artificial Sequence
  Synthetic
uaauuuuuguauuuuuag

SEQ ID NO: 25897 - RNA, 19 nt, Artificial Sequence
  Synthetic
cuaauuuuuguauuuuuag

SEQ ID NO: 25898 - RNA, 20 nt, Artificial Sequence
  Synthetic
gcuaauuuuuguauuuuuag

SEQ ID NO: 25899 - RNA, 21 nt, Artificial Sequence
  Synthetic
agcuaauuuuuguauuuuuag

SEQ ID NO: 25900 - RNA, 22 nt, Artificial Sequence
  Synthetic
cagcuaauuuuuguauuuuuag

SEQ ID NO: 25901 - RNA, 23 nt, Artificial Sequence
  Synthetic
ucagcuaauuuuuguauuuuuag

SEQ ID NO: 25902 - RNA, 24 nt, Artificial Sequence
  Synthetic
cucagcuaauuuuuguauuuuuag

SEQ ID NO: 25903 - RNA, 23 nt, Artificial Sequence
  Synthetic
cggcuaauuuuuuguauuuuuag

SEQ ID NO: 25904 - RNA, 24 nt, Artificial Sequence
  Synthetic
ccggcuaauuuuuuguauuuuuag

SEQ ID NO: 25905 - RNA, 18 nt, Artificial Sequence
  Synthetic
ucagagaaguaaucggcg

SEQ ID NO: 25906 - RNA, 19 nt, Artificial Sequence
  Synthetic
gucagagaaguaaucggcg

SEQ ID NO: 25907 - RNA, 20 nt, Artificial Sequence
  Synthetic
ugucagagaaguaaucggcg

SEQ ID NO: 25908 - RNA, 21 nt, Artificial Sequence
  Synthetic
cugucagagaaguaaucggcg

SEQ ID NO: 25909 - RNA, 22 nt, Artificial Sequence
  Synthetic
acugucagagaaguaaucggcg

SEQ ID NO: 25910 - RNA, 23 nt, Artificial Sequence
  Synthetic
uacugucagagaaguaaucggcg

SEQ ID NO: 25911 - RNA, 24 nt, Artificial Sequence
  Synthetic
auacugucagagaaguaaucggcg

SEQ ID NO: 25912 - RNA, 18 nt, Artificial Sequence
  Synthetic
uucuguagggagacaagg

SEQ ID NO: 25913 - RNA, 19 nt, Artificial Sequence
  Synthetic
auucuguagggagacaagg

SEQ ID NO: 25914 - RNA, 20 nt, Artificial Sequence
  Synthetic
uauucuguagggagacaagg

SEQ ID NO: 25915 - RNA, 21 nt, Artificial Sequence
  Synthetic
cuauucuguagggagacaagg

SEQ ID NO: 25916 - RNA, 22 nt, Artificial Sequence
  Synthetic
gcuauucuguagggagacaagg

SEQ ID NO: 25917 - RNA, 23 nt, Artificial Sequence
  Synthetic
ggcuauucuguagggagacaagg

SEQ ID NO: 25918 - RNA, 24 nt, Artificial Sequence
  Synthetic
aggcuauucuguagggagacaagg

SEQ ID NO: 25919 - RNA, 18 nt, Artificial Sequence
  Synthetic
acaagucuaguuucaagg

SEQ ID NO: 25920 - RNA, 19 nt, Artificial Sequence
  Synthetic
uacaagucuaguuucaagg

SEQ ID NO: 25921 - RNA, 20 nt, Artificial Sequence
  Synthetic
guacaagucuaguuucaagg

SEQ ID NO: 25922 - RNA, 21 nt, Artificial Sequence
  Synthetic
uguacaagucuaguuucaagg

SEQ ID NO: 25923 - RNA, 22 nt, Artificial Sequence
  Synthetic
auguacaagucuaguuucaagg

SEQ ID NO: 25924 - RNA, 23 nt, Artificial Sequence
  Synthetic
gauguacaagucuaguuucaagg

SEQ ID NO: 25925 - RNA, 24 nt, Artificial Sequence
  Synthetic
ggauguacaagucuaguuucaagg

SEQ ID NO: 25926 - RNA, 18 nt, Artificial Sequence
  Synthetic
ggaaggaaggaaagaagg

SEQ ID NO: 25927 - RNA, 19 nt, Artificial Sequence
  Synthetic
aggaaggaaggaaagaagg

SEQ ID NO: 25928 - RNA, 20 nt, Artificial Sequence
  Synthetic
aaggaaggaaggaaagaagg

SEQ ID NO: 25929 - RNA, 21 nt, Artificial Sequence
  Synthetic
gaaggaaggaaggaaagaagg

SEQ ID NO: 25930 - RNA, 22 nt, Artificial Sequence
  Synthetic
ggaaggaaggaaggaaagaagg

SEQ ID NO: 25931 - RNA, 23 nt, Artificial Sequence
  Synthetic
aggaaggaaggaaggaaagaagg

SEQ ID NO: 25932 - RNA, 24 nt, Artificial Sequence
  Synthetic
gaggaaggaaggaaggaaagaagg

SEQ ID NO: 25933 - RNA, 18 nt, Artificial Sequence
  Synthetic
aaguaggaggaaggaagg

SEQ ID NO: 25934 - RNA, 19 nt, Artificial Sequence
  Synthetic
gaaguaggaggaaggaagg

SEQ ID NO: 25935 - RNA, 20 nt, Artificial Sequence
  Synthetic
ggaaguaggaggaaggaagg

SEQ ID NO: 25936 - RNA, 21 nt, Artificial Sequence
  Synthetic
aggaaguaggaggaaggaagg

SEQ ID NO: 25937 - RNA, 22 nt, Artificial Sequence
  Synthetic
aaggaaguaggaggaaggaagg

SEQ ID NO: 25938 - RNA, 23 nt, Artificial Sequence
  Synthetic
aaaggaaguaggaggaaggaagg

SEQ ID NO: 25939 - RNA, 24 nt, Artificial Sequence
  Synthetic
gaaaggaaguaggaggaaggaagg

SEQ ID NO: 25940 - RNA, 18 nt, Artificial Sequence
  Synthetic
aaaagaaagagaggaagg

SEQ ID NO: 25941 - RNA, 19 nt, Artificial Sequence
  Synthetic
aaaaagaaagagaggaagg

SEQ ID NO: 25942 - RNA, 20 nt, Artificial Sequence
  Synthetic
gaaaaagaaagagaggaagg

SEQ ID NO: 25943 - RNA, 21 nt, Artificial Sequence
  Synthetic
agaaaaagaaagagaggaagg

SEQ ID NO: 25944 - RNA, 22 nt, Artificial Sequence
  Synthetic
cagaaaaagaaagagaggaagg

SEQ ID NO: 25945 - RNA, 23 nt, Artificial Sequence
  Synthetic
acagaaaaagaaagagaggaagg

SEQ ID NO: 25946 - RNA, 24 nt, Artificial Sequence
  Synthetic
aacagaaaaagaaagagaggaagg

SEQ ID NO: 25947 - RNA, 18 nt, Artificial Sequence
  Synthetic
aaggaaguaggaggaagg

SEQ ID NO: 25948 - RNA, 19 nt, Artificial Sequence
  Synthetic
aaaggaaguaggaggaagg

SEQ ID NO: 25949 - RNA, 20 nt, Artificial Sequence
  Synthetic
gaaaggaaguaggaggaagg

SEQ ID NO: 25950 - RNA, 21 nt, Artificial Sequence
  Synthetic
agaaaggaaguaggaggaagg

SEQ ID NO: 25951 - RNA, 22 nt, Artificial Sequence
  Synthetic
aagaaaggaaguaggaggaagg

SEQ ID NO: 25952 - RNA, 23 nt, Artificial Sequence
  Synthetic
gaagaaaggaaguaggaggaagg

SEQ ID NO: 25953 - RNA, 24 nt, Artificial Sequence
  Synthetic
ggaagaaaggaaguaggaggaagg

SEQ ID NO: 25954 - RNA, 18 nt, Artificial Sequence
  Synthetic
agucuuacugucaccagg

SEQ ID NO: 25955 - RNA, 19 nt, Artificial Sequence
  Synthetic
gagucuuacugucaccagg

SEQ ID NO: 25956 - RNA, 20 nt, Artificial Sequence
  Synthetic
agagucuuacugucaccagg

SEQ ID NO: 25957 - RNA, 21 nt, Artificial Sequence
  Synthetic
cagagucuuacugucaccagg

SEQ ID NO: 25958 - RNA, 22 nt, Artificial Sequence
  Synthetic
acagagucuuacugucaccagg

SEQ ID NO: 25959 - RNA, 23 nt, Artificial Sequence
  Synthetic
gacagagucuuacugucaccagg

SEQ ID NO: 25960 - RNA, 24 nt, Artificial Sequence
  Synthetic
agacagagucuuacugucaccagg

SEQ ID NO: 25961 - RNA, 18 nt, Artificial Sequence
  Synthetic
cuuacucugucacccagg

SEQ ID NO: 25962 - RNA, 19 nt, Artificial Sequence
  Synthetic
ucuuacucugucacccagg

SEQ ID NO: 25963 - RNA, 20 nt, Artificial Sequence
  Synthetic
gucuuacucugucacccagg

SEQ ID NO: 25964 - RNA, 21 nt, Artificial Sequence
  Synthetic
ggucuuacucugucacccagg

SEQ ID NO: 25965 - RNA, 22 nt, Artificial Sequence
  Synthetic
aggucuuacucugucacccagg

SEQ ID NO: 25966 - RNA, 23 nt, Artificial Sequence
  Synthetic
uaggucuuacucugucacccagg

SEQ ID NO: 25967 - RNA, 24 nt, Artificial Sequence
  Synthetic
uuaggucuuacucugucacccagg

SEQ ID NO: 25968 - RNA, 18 nt, Artificial Sequence
  Synthetic
cucgcucugucgcccagg

SEQ ID NO: 25969 - RNA, 19 nt, Artificial Sequence
  Synthetic
ucucgcucugucgcccagg

SEQ ID NO: 25970 - RNA, 20 nt, Artificial Sequence
  Synthetic
gucucgcucugucgcccagg

SEQ ID NO: 25971 - RNA, 21 nt, Artificial Sequence
  Synthetic
agucucgcucugucgcccagg

SEQ ID NO: 25972 - RNA, 22 nt, Artificial Sequence
  Synthetic
gagucucgcucugucgcccagg

SEQ ID NO: 25973 - RNA, 23 nt, Artificial Sequence
  Synthetic
ggagucucgcucugucgcccagg

SEQ ID NO: 25974 - RNA, 24 nt, Artificial Sequence
  Synthetic
cggagucucgcucugucgcccagg

SEQ ID NO: 25975 - RNA, 18 nt, Artificial Sequence
  Synthetic
aggugaugguauugcagg

SEQ ID NO: 25976 - RNA, 19 nt, Artificial Sequence
  Synthetic
aaggugaugguauugcagg

SEQ ID NO: 25977 - RNA, 20 nt, Artificial Sequence
  Synthetic
caaggugaugguauugcagg

SEQ ID NO: 25978 - RNA, 21 nt, Artificial Sequence
  Synthetic
ccaaggugaugguauugcagg

SEQ ID NO: 25979 - RNA, 22 nt, Artificial Sequence
  Synthetic
cccaaggugaugguauugcagg

SEQ ID NO: 25980 - RNA, 23 nt, Artificial Sequence
  Synthetic
ucccaaggugaugguauugcagg

SEQ ID NO: 25981 - RNA, 24 nt, Artificial Sequence
  Synthetic
uucccaaggugaugguauugcagg

SEQ ID NO: 25982 - RNA, 18 nt, Artificial Sequence
  Synthetic
cagaaaaagaaagagagg

SEQ ID NO: 25983 - RNA, 19 nt, Artificial Sequence
  Synthetic
acagaaaaagaaagagagg

SEQ ID NO: 25984 - RNA, 20 nt, Artificial Sequence
  Synthetic
aacagaaaaagaaagagagg

SEQ ID NO: 25985 - RNA, 21 nt, Artificial Sequence
  Synthetic
aaacagaaaaagaaagagagg

SEQ ID NO: 25986 - RNA, 22 nt, Artificial Sequence
  Synthetic
caaacagaaaaagaaagagagg

SEQ ID NO: 25987 - RNA, 23 nt, Artificial Sequence
  Synthetic
acaaacagaaaaagaaagagagg

SEQ ID NO: 25988 - RNA, 24 nt, Artificial Sequence
  Synthetic
gacaaacagaaaaagaaagagagg

SEQ ID NO: 25989 - RNA, 18 nt, Artificial Sequence
  Synthetic
uggcgugaacccaggagg

SEQ ID NO: 25990 - RNA, 19 nt, Artificial Sequence
  Synthetic
auggcgugaacccaggagg

SEQ ID NO: 25991 - RNA, 20 nt, Artificial Sequence
  Synthetic
aauggcgugaacccaggagg

SEQ ID NO: 25992 - RNA, 21 nt, Artificial Sequence
  Synthetic
gaauggcgugaacccaggagg

SEQ ID NO: 25993 - RNA, 22 nt, Artificial Sequence
  Synthetic
agaauggcgugaacccaggagg

SEQ ID NO: 25994 - RNA, 23 nt, Artificial Sequence
  Synthetic
gagaauggcgugaacccaggagg

SEQ ID NO: 25995 - RNA, 24 nt, Artificial Sequence
  Synthetic
ggagaauggcgugaacccaggagg

SEQ ID NO: 25996 - RNA, 18 nt, Artificial Sequence
  Synthetic
aagaaaggaaguaggagg

SEQ ID NO: 25997 - RNA, 19 nt, Artificial Sequence
  Synthetic
gaagaaaggaaguaggagg

SEQ ID NO: 25998 - RNA, 20 nt, Artificial Sequence
  Synthetic
ggaagaaaggaaguaggagg

SEQ ID NO: 25999 - RNA, 21 nt, Artificial Sequence
  Synthetic
aggaagaaaggaaguaggagg

SEQ ID NO: 26000 - RNA, 22 nt, Artificial Sequence
  Synthetic
gaggaagaaaggaaguaggagg

SEQ ID NO: 26001 - RNA, 23 nt, Artificial Sequence
  Synthetic
ugaggaagaaaggaaguaggagg

SEQ ID NO: 26002 - RNA, 24 nt, Artificial Sequence
  Synthetic
augaggaagaaaggaaguaggagg

SEQ ID NO: 26003 - RNA, 18 nt, Artificial Sequence
  Synthetic
ucccagcuacucgggagg

SEQ ID NO: 26004 - RNA, 19 nt, Artificial Sequence
  Synthetic
gucccagcuacucgggagg

SEQ ID NO: 26005 - RNA, 20 nt, Artificial Sequence
  Synthetic
agucccagcuacucgggagg

SEQ ID NO: 26006 - RNA, 21 nt, Artificial Sequence
  Synthetic
uagucccagcuacucgggagg

SEQ ID NO: 26007 - RNA, 22 nt, Artificial Sequence
  Synthetic
guagucccagcuacucgggagg

SEQ ID NO: 26008 - RNA, 23 nt, Artificial Sequence
  Synthetic
cguagucccagcuacucgggagg

SEQ ID NO: 26009 - RNA, 24 nt, Artificial Sequence
  Synthetic
ccguagucccagcuacucgggagg

SEQ ID NO: 26010 - RNA, 18 nt, Artificial Sequence
  Synthetic
aguaaucggcgguggagg

SEQ ID NO: 26011 - RNA, 19 nt, Artificial Sequence
  Synthetic
aaguaaucggcgguggagg

SEQ ID NO: 26012 - RNA, 20 nt, Artificial Sequence
  Synthetic
gaaguaaucggcgguggagg

SEQ ID NO: 26013 - RNA, 21 nt, Artificial Sequence
  Synthetic
agaaguaaucggcgguggagg

SEQ ID NO: 26014 - RNA, 22 nt, Artificial Sequence
  Synthetic
gagaaguaaucggcgguggagg

SEQ ID NO: 26015 - RNA, 23 nt, Artificial Sequence
  Synthetic
agagaaguaaucggcgguggagg

SEQ ID NO: 26016 - RNA, 24 nt, Artificial Sequence
  Synthetic
cagagaaguaaucggcgguggagg

SEQ ID NO: 26017 - RNA, 18 nt, Artificial Sequence
  Synthetic
uccuagcacuuuuggagg

SEQ ID NO: 26018 - RNA, 19 nt, Artificial Sequence
  Synthetic
auccuagcacuuuuggagg

SEQ ID NO: 26019 - RNA, 20 nt, Artificial Sequence
  Synthetic
aauccuagcacuuuuggagg

SEQ ID NO: 26020 - RNA, 21 nt, Artificial Sequence
  Synthetic
uaauccuagcacuuuuggagg

SEQ ID NO: 26021 - RNA, 22 nt, Artificial Sequence
  Synthetic
guaauccuagcacuuuuggagg

SEQ ID NO: 26022 - RNA, 23 nt, Artificial Sequence
  Synthetic
uguaauccuagcacuuuuggagg

SEQ ID NO: 26023 - RNA, 24 nt, Artificial Sequence
  Synthetic
uuguaauccuagcacuuuuggagg

SEQ ID NO: 26024 - RNA, 18 nt, Artificial Sequence
  Synthetic
agaaagaaggaaaugagg

SEQ ID NO: 26025 - RNA, 19 nt, Artificial Sequence
  Synthetic
aagaaagaaggaaaugagg

SEQ ID NO: 26026 - RNA, 20 nt, Artificial Sequence
  Synthetic
gaagaaagaaggaaaugagg

SEQ ID NO: 26027 - RNA, 21 nt, Artificial Sequence
  Synthetic
ggaagaaagaaggaaaugagg

SEQ ID NO: 26028 - RNA, 22 nt, Artificial Sequence
  Synthetic
aggaagaaagaaggaaaugagg

SEQ ID NO: 26029 - RNA, 23 nt, Artificial Sequence
  Synthetic
aaggaagaaagaaggaaaugagg

SEQ ID NO: 26030 - RNA, 24 nt, Artificial Sequence
  Synthetic
gaaggaagaaagaaggaaaugagg

SEQ ID NO: 26031 - RNA, 18 nt, Artificial Sequence
  Synthetic
ggugauuaguccaugagg

SEQ ID NO: 26032 - RNA, 19 nt, Artificial Sequence
  Synthetic
aggugauuaguccaugagg

SEQ ID NO: 26033 - RNA, 20 nt, Artificial Sequence
  Synthetic
gaggugauuaguccaugagg

SEQ ID NO: 26034 - RNA, 21 nt, Artificial Sequence
  Synthetic
ggaggugauuaguccaugagg

SEQ ID NO: 26035 - RNA, 22 nt, Artificial Sequence
  Synthetic
gggaggugauuaguccaugagg

SEQ ID NO: 26036 - RNA, 23 nt, Artificial Sequence
  Synthetic
ugggaggugauuaguccaugagg

SEQ ID NO: 26037 - RNA, 24 nt, Artificial Sequence
  Synthetic
uugggaggugauuaguccaugagg

SEQ ID NO: 26038 - RNA, 18 nt, Artificial Sequence
  Synthetic
cuacucgggaggcugagg

SEQ ID NO: 26039 - RNA, 19 nt, Artificial Sequence
  Synthetic
gcuacucgggaggcugagg

SEQ ID NO: 26040 - RNA, 20 nt, Artificial Sequence
  Synthetic
agcuacucgggaggcugagg

SEQ ID NO: 26041 - RNA, 21 nt, Artificial Sequence
  Synthetic
cagcuacucgggaggcugagg

SEQ ID NO: 26042 - RNA, 22 nt, Artificial Sequence
  Synthetic
ccagcuacucgggaggcugagg

SEQ ID NO: 26043 - RNA, 23 nt, Artificial Sequence
  Synthetic
cccagcuacucgggaggcugagg

SEQ ID NO: 26044 - RNA, 24 nt, Artificial Sequence
  Synthetic
ucccagcuacucgggaggcugagg

SEQ ID NO: 26045 - RNA, 18 nt, Artificial Sequence
  Synthetic
cuacuugggaggcugagg

SEQ ID NO: 26046 - RNA, 19 nt, Artificial Sequence
  Synthetic
gcuacuugggaggcugagg

SEQ ID NO: 26047 - RNA, 18 nt, Artificial Sequence
  Synthetic
aaaaaauuauacuauagg

SEQ ID NO: 26048 - RNA, 19 nt, Artificial Sequence
  Synthetic
uaaaaaauuauacuauagg

SEQ ID NO: 26049 - RNA, 21 nt, Artificial Sequence
  Synthetic
auuaaaaaauuauacuauagg

SEQ ID NO: 26050 - RNA, 22 nt, Artificial Sequence
  Synthetic
uauuaaaaaauuauacuauagg

SEQ ID NO: 26051 - RNA, 23 nt, Artificial Sequence
  Synthetic
cuauuaaaaaauuauacuauagg

SEQ ID NO: 26052 - RNA, 24 nt, Artificial Sequence
  Synthetic
acuauuaaaaaauuauacuauagg

SEQ ID NO: 26053 - RNA, 18 nt, Artificial Sequence
  Synthetic
aggaagaaaggaaguagg

SEQ ID NO: 26054 - RNA, 19 nt, Artificial Sequence
  Synthetic
gaggaagaaaggaaguagg

SEQ ID NO: 26055 - RNA, 21 nt, Artificial Sequence
  Synthetic
augaggaagaaaggaaguagg

SEQ ID NO: 26056 - RNA, 22 nt, Artificial Sequence
  Synthetic
aaugaggaagaaaggaaguagg

SEQ ID NO: 26057 - RNA, 23 nt, Artificial Sequence
  Synthetic
aaaugaggaagaaaggaaguagg

SEQ ID NO: 26058 - RNA, 24 nt, Artificial Sequence
  Synthetic
gaaaugaggaagaaaggaaguagg

SEQ ID NO: 26059 - RNA, 18 nt, Artificial Sequence
  Synthetic
cagagaaguaaucggcgg

SEQ ID NO: 26060 - RNA, 19 nt, Artificial Sequence
  Synthetic
ucagagaaguaaucggcgg

SEQ ID NO: 26061 - RNA, 21 nt, Artificial Sequence
  Synthetic
ugucagagaaguaaucggcgg

SEQ ID NO: 26062 - RNA, 22 nt, Artificial Sequence
  Synthetic
cugucagagaaguaaucggcgg

SEQ ID NO: 26063 - RNA, 23 nt, Artificial Sequence
  Synthetic
acugucagagaaguaaucggcgg

SEQ ID NO: 26064 - RNA, 24 nt, Artificial Sequence
  Synthetic
uacugucagagaaguaaucggcgg

SEQ ID NO: 26065 - RNA, 18 nt, Artificial Sequence
  Synthetic
ucuguagggagacaaggg

SEQ ID NO: 26066 - RNA, 19 nt, Artificial Sequence
  Synthetic
uucuguagggagacaaggg

SEQ ID NO: 26067 - RNA, 21 nt, Artificial Sequence
  Synthetic
uauucuguagggagacaaggg

SEQ ID NO: 26068 - RNA, 22 nt, Artificial Sequence
  Synthetic
cuauucuguagggagacaaggg

SEQ ID NO: 26069 - RNA, 23 nt, Artificial Sequence
  Synthetic
gcuauucuguagggagacaaggg

SEQ ID NO: 26070 - RNA, 24 nt, Artificial Sequence
  Synthetic
ggcuauucuguagggagacaaggg

SEQ ID NO: 26071 - RNA, 18 nt, Artificial Sequence
  Synthetic
ggugaugguauugcaggg

SEQ ID NO: 26072 - RNA, 19 nt, Artificial Sequence
  Synthetic
aggugaugguauugcaggg

SEQ ID NO: 26073 - RNA, 21 nt, Artificial Sequence
  Synthetic
caaggugaugguauugcaggg

SEQ ID NO: 26074 - RNA, 22 nt, Artificial Sequence
  Synthetic
ccaaggugaugguauugcaggg

SEQ ID NO: 26075 - RNA, 23 nt, Artificial Sequence
  Synthetic
cccaaggugaugguauugcaggg

SEQ ID NO: 26076 - RNA, 24 nt, Artificial Sequence
  Synthetic
ucccaaggugaugguauugcaggg

SEQ ID NO: 26077 - RNA, 18 nt, Artificial Sequence
  Synthetic
caggagccaaaaauuggg

SEQ ID NO: 26078 - RNA, 19 nt, Artificial Sequence
  Synthetic
ucaggagccaaaaauuggg

SEQ ID NO: 26079 - RNA, 21 nt, Artificial Sequence
  Synthetic
uuucaggagccaaaaauuggg

SEQ ID NO: 26080 - RNA, 22 nt, Artificial Sequence
  Synthetic
cuuucaggagccaaaaauuggg

SEQ ID NO: 26081 - RNA, 23 nt, Artificial Sequence
  Synthetic
gcuuucaggagccaaaaauuggg

SEQ ID NO: 26082 - RNA, 24 nt, Artificial Sequence
  Synthetic
ugcuuucaggagccaaaaauuggg

SEQ ID NO: 26083 - RNA, 18 nt, Artificial Sequence
  Synthetic
uuacuagaaagauaaugg

SEQ ID NO: 26084 - RNA, 19 nt, Artificial Sequence
  Synthetic
uuuacuagaaagauaaugg

SEQ ID NO: 26085 - RNA, 20 nt, Artificial Sequence
  Synthetic
guuuacuagaaagauaaugg

SEQ ID NO: 26086 - RNA, 21 nt, Artificial Sequence
  Synthetic
cguuuacuagaaagauaaugg

SEQ ID NO: 26087 - RNA, 22 nt, Artificial Sequence
  Synthetic
ccguuuacuagaaagauaaugg

SEQ ID NO: 26088 - RNA, 23 nt, Artificial Sequence
  Synthetic
gccguuuacuagaaagauaaugg

SEQ ID NO: 26089 - RNA, 24 nt, Artificial Sequence
  Synthetic
ugccguuuacuagaaagauaaugg

SEQ ID NO: 26090 - RNA, 18 nt, Artificial Sequence
  Synthetic
uaaggcuuauuucucugg

SEQ ID NO: 26091 - RNA, 19 nt, Artificial Sequence
  Synthetic
cuaaggcuuauuucucugg

SEQ ID NO: 26092 - RNA, 20 nt, Artificial Sequence
  Synthetic
acuaaggcuuauuucucugg

SEQ ID NO: 26093 - RNA, 21 nt, Artificial Sequence
  Synthetic
gacuaaggcuuauuucucugg

SEQ ID NO: 26094 - RNA, 22 nt, Artificial Sequence
  Synthetic
agacuaaggcuuauuucucugg

SEQ ID NO: 26095 - RNA, 23 nt, Artificial Sequence
  Synthetic
aagacuaaggcuuauuucucugg

SEQ ID NO: 26096 - RNA, 24 nt, Artificial Sequence
  Synthetic
aaagacuaaggcuuauuucucugg

SEQ ID NO: 26097 - RNA, 18 nt, Artificial Sequence
  Synthetic
uagagguuaaggaggugg

SEQ ID NO: 26098 - RNA, 19 nt, Artificial Sequence
  Synthetic
uuagagguuaaggaggugg

SEQ ID NO: 26099 - RNA, 20 nt, Artificial Sequence
  Synthetic
auuagagguuaaggaggugg

SEQ ID NO: 26100 - RNA, 21 nt, Artificial Sequence
  Synthetic
uauuagagguuaaggaggugg

SEQ ID NO: 26101 - RNA, 22 nt, Artificial Sequence
  Synthetic
guauuagagguuaaggaggugg

SEQ ID NO: 26102 - RNA, 23 nt, Artificial Sequence
  Synthetic
aguauuagagguuaaggaggugg

SEQ ID NO: 26103 - RNA, 24 nt, Artificial Sequence
  Synthetic
aaguauuagagguuaaggaggugg

SEQ ID NO: 26104 - RNA, 18 nt, Artificial Sequence
  Synthetic
gagccaaaaauugggugg

SEQ ID NO: 26105 - RNA, 19 nt, Artificial Sequence
  Synthetic
ggagccaaaaauugggugg

SEQ ID NO: 26106 - RNA, 21 nt, Artificial Sequence
  Synthetic
caggagccaaaaauugggugg

SEQ ID NO: 26107 - RNA, 22 nt, Artificial Sequence
  Synthetic
ucaggagccaaaaauugggugg

SEQ ID NO: 26108 - RNA, 23 nt, Artificial Sequence
  Synthetic
uucaggagccaaaaauugggugg

SEQ ID NO: 26109 - RNA, 24 nt, Artificial Sequence
  Synthetic
uuucaggagccaaaaauugggugg

SEQ ID NO: 26110 - RNA, 18 nt, Artificial Sequence
  Synthetic
ucaggagccaaaaauugg

SEQ ID NO: 26111 - RNA, 19 nt, Artificial Sequence
  Synthetic
uucaggagccaaaaauugg

SEQ ID NO: 26112 - RNA, 20 nt, Artificial Sequence
  Synthetic
uuucaggagccaaaaauugg

SEQ ID NO: 26113 - RNA, 21 nt, Artificial Sequence
  Synthetic
cuuucaggagccaaaaauugg

SEQ ID NO: 26114 - RNA, 22 nt, Artificial Sequence
  Synthetic
gcuuucaggagccaaaaauugg

SEQ ID NO: 26115 - RNA, 23 nt, Artificial Sequence
  Synthetic
ugcuuucaggagccaaaaauugg

SEQ ID NO: 26116 - RNA, 24 nt, Artificial Sequence
  Synthetic
cugcuuucaggagccaaaaauugg

SEQ ID NO: 26117 - RNA, 18 nt, Artificial Sequence
  Synthetic
gggagaaacagguuuugg

SEQ ID NO: 26118 - RNA, 19 nt, Artificial Sequence
  Synthetic
ugggagaaacagguuuugg

SEQ ID NO: 26119 - RNA, 20 nt, Artificial Sequence
  Synthetic
augggagaaacagguuuugg

SEQ ID NO: 26120 - RNA, 21 nt, Artificial Sequence
  Synthetic
aaugggagaaacagguuuugg

SEQ ID NO: 26121 - RNA, 22 nt, Artificial Sequence
  Synthetic
uaaugggagaaacagguuuugg

SEQ ID NO: 26122 - RNA, 23 nt, Artificial Sequence
  Synthetic
auaaugggagaaacagguuuugg

SEQ ID NO: 26123 - RNA, 24 nt, Artificial Sequence
  Synthetic
gauaaugggagaaacagguuuugg

SEQ ID NO: 26124 - RNA, 18 nt, Artificial Sequence
  Synthetic
ggaagaaagaaggaaaug

SEQ ID NO: 26125 - RNA, 19 nt, Artificial Sequence
  Synthetic
aggaagaaagaaggaaaug

SEQ ID NO: 26126 - RNA, 21 nt, Artificial Sequence
  Synthetic
gaaggaagaaagaaggaaaug

SEQ ID NO: 26127 - RNA, 22 nt, Artificial Sequence
  Synthetic
ggaaggaagaaagaaggaaaug

SEQ ID NO: 26128 - RNA, 23 nt, Artificial Sequence
  Synthetic
aggaaggaagaaagaaggaaaug

SEQ ID NO: 26129 - RNA, 24 nt, Artificial Sequence
  Synthetic
gaggaaggaagaaagaaggaaaug

SEQ ID NO: 26130 - RNA, 18 nt, Artificial Sequence
  Synthetic
uuaucaauaucuaagaug

SEQ ID NO: 26131 - RNA, 19 nt, Artificial Sequence
  Synthetic
uuuaucaauaucuaagaug

SEQ ID NO: 26132 - RNA, 21 nt, Artificial Sequence
  Synthetic
uauuuaucaauaucuaagaug

SEQ ID NO: 26133 - RNA, 22 nt, Artificial Sequence
  Synthetic
uuauuuaucaauaucuaagaug

SEQ ID NO: 26134 - RNA, 23 nt, Artificial Sequence
  Synthetic
auuauuuaucaauaucuaagaug

SEQ ID NO: 26135 - RNA, 24 nt, Artificial Sequence
  Synthetic
aauuauuuaucaauaucuaagaug

SEQ ID NO: 26136 - RNA, 18 nt, Artificial Sequence
  Synthetic
uccccugccauucauaug

SEQ ID NO: 26137 - RNA, 19 nt, Artificial Sequence
  Synthetic
cuccccugccauucauaug

SEQ ID NO: 26138 - RNA, 20 nt, Artificial Sequence
  Synthetic
ucuccccugccauucauaug

SEQ ID NO: 26139 - RNA, 21 nt, Artificial Sequence
  Synthetic
cucuccccugccauucauaug

SEQ ID NO: 26140 - RNA, 22 nt, Artificial Sequence
  Synthetic
ucucuccccugccauucauaug

SEQ ID NO: 26141 - RNA, 23 nt, Artificial Sequence
  Synthetic
gucucuccccugccauucauaug

SEQ ID NO: 26142 - RNA, 24 nt, Artificial Sequence
  Synthetic
ugucucuccccugccauucauaug

SEQ ID NO: 26143 - RNA, 18 nt, Artificial Sequence
  Synthetic
uguuuuuaggcuauucug

SEQ ID NO: 26144 - RNA, 19 nt, Artificial Sequence
  Synthetic
auguuuuuaggcuauucug

SEQ ID NO: 26145 - RNA, 20 nt, Artificial Sequence
  Synthetic
aauguuuuuaggcuauucug

SEQ ID NO: 26146 - RNA, 21 nt, Artificial Sequence
  Synthetic
uaauguuuuuaggcuauucug

SEQ ID NO: 26147 - RNA, 22 nt, Artificial Sequence
  Synthetic
cuaauguuuuuaggcuauucug

SEQ ID NO: 26148 - RNA, 23 nt, Artificial Sequence
  Synthetic
gcuaauguuuuuaggcuauucug

SEQ ID NO: 26149 - RNA, 24 nt, Artificial Sequence
  Synthetic
ggcuaauguuuuuaggcuauucug

SEQ ID NO: 26150 - RNA, 18 nt, Artificial Sequence
  Synthetic
ccucggccucccaaagug

SEQ ID NO: 26151 - RNA, 19 nt, Artificial Sequence
  Synthetic
gccucggccucccaaagug

SEQ ID NO: 26152 - RNA, 20 nt, Artificial Sequence
  Synthetic
cgccucggccucccaaagug

SEQ ID NO: 26153 - RNA, 21 nt, Artificial Sequence
  Synthetic
ccgccucggccucccaaagug

SEQ ID NO: 26154 - RNA, 22 nt, Artificial Sequence
  Synthetic
cccgccucggccucccaaagug

SEQ ID NO: 26155 - RNA, 23 nt, Artificial Sequence
  Synthetic
gcccgccucggccucccaaagug

SEQ ID NO: 26156 - RNA, 24 nt, Artificial Sequence
  Synthetic
cgcccgccucggccucccaaagug

SEQ ID NO: 26157 - RNA, 20 nt, Artificial Sequence
  Synthetic
ugccucggccucccaaagug

SEQ ID NO: 26158 - RNA, 21 nt, Artificial Sequence
  Synthetic
cugccucggccucccaaagug

SEQ ID NO: 26159 - RNA, 22 nt, Artificial Sequence
  Synthetic
ccugccucggccucccaaagug

SEQ ID NO: 26160 - RNA, 23 nt, Artificial Sequence
  Synthetic
gccugccucggccucccaaagug

SEQ ID NO: 26161 - RNA, 24 nt, Artificial Sequence
  Synthetic
ugccugccucggccucccaaagug

SEQ ID NO: 26162 - RNA, 18 nt, Artificial Sequence
  Synthetic
ccaggcuggagugcagug

SEQ ID NO: 26163 - RNA, 19 nt, Artificial Sequence
  Synthetic
cccaggcuggagugcagug

SEQ ID NO: 26164 - RNA, 20 nt, Artificial Sequence
  Synthetic
gcccaggcuggagugcagug

SEQ ID NO: 26165 - RNA, 21 nt, Artificial Sequence
  Synthetic
cgcccaggcuggagugcagug

SEQ ID NO: 26166 - RNA, 22 nt, Artificial Sequence
  Synthetic
ucgcccaggcuggagugcagug

SEQ ID NO: 26167 - RNA, 23 nt, Artificial Sequence
  Synthetic
gucgcccaggcuggagugcagug

SEQ ID NO: 26168 - RNA, 24 nt, Artificial Sequence
  Synthetic
ugucgcccaggcuggagugcagug

SEQ ID NO: 26169 - RNA, 18 nt, Artificial Sequence
  Synthetic
uaagaagagaaaggggug

SEQ ID NO: 26170 - RNA, 19 nt, Artificial Sequence
  Synthetic
auaagaagagaaaggggug

SEQ ID NO: 26171 - RNA, 20 nt, Artificial Sequence
  Synthetic
gauaagaagagaaaggggug

SEQ ID NO: 26172 - RNA, 21 nt, Artificial Sequence
  Synthetic
ugauaagaagagaaaggggug

SEQ ID NO: 26173 - RNA, 22 nt, Artificial Sequence
  Synthetic
uugauaagaagagaaaggggug

SEQ ID NO: 26174 - RNA, 23 nt, Artificial Sequence
  Synthetic
guugauaagaagagaaaggggug

SEQ ID NO: 26175 - RNA, 24 nt, Artificial Sequence
  Synthetic
gguugauaagaagagaaaggggug

SEQ ID NO: 26176 - RNA, 18 nt, Artificial Sequence
  Synthetic
agguuaaggaggugggug

SEQ ID NO: 26177 - RNA, 19 nt, Artificial Sequence
  Synthetic
gagguuaaggaggugggug

SEQ ID NO: 26178 - RNA, 20 nt, Artificial Sequence
  Synthetic
agagguuaaggaggugggug

SEQ ID NO: 26179 - RNA, 21 nt, Artificial Sequence
  Synthetic
uagagguuaaggaggugggug

SEQ ID NO: 26180 - RNA, 22 nt, Artificial Sequence
  Synthetic
uuagagguuaaggaggugggug

SEQ ID NO: 26181 - RNA, 23 nt, Artificial Sequence
  Synthetic
auuagagguuaaggaggugggug

SEQ ID NO: 26182 - RNA, 24 nt, Artificial Sequence
  Synthetic
uauuagagguuaaggaggugggug

SEQ ID NO: 26183 - RNA, 18 nt, Artificial Sequence
  Synthetic
ggagccaaaaauugggug

SEQ ID NO: 26184 - RNA, 19 nt, Artificial Sequence
  Synthetic
aggagccaaaaauugggug

SEQ ID NO: 26185 - RNA, 21 nt, Artificial Sequence
  Synthetic
ucaggagccaaaaauugggug

SEQ ID NO: 26186 - RNA, 22 nt, Artificial Sequence
  Synthetic
uucaggagccaaaaauugggug

SEQ ID NO: 26187 - RNA, 23 nt, Artificial Sequence
  Synthetic
uuucaggagccaaaaauugggug

SEQ ID NO: 26188 - RNA, 24 nt, Artificial Sequence
  Synthetic
cuuucaggagccaaaaauugggug

SEQ ID NO: 26189 - RNA, 18 nt, Artificial Sequence
  Synthetic
uggcaucucaccagugug

SEQ ID NO: 26190 - RNA, 19 nt, Artificial Sequence
  Synthetic
auggcaucucaccagugug

SEQ ID NO: 26191 - RNA, 21 nt, Artificial Sequence
  Synthetic
uuauggcaucucaccagugug

SEQ ID NO: 26192 - RNA, 22 nt, Artificial Sequence
  Synthetic
cuuauggcaucucaccagugug

SEQ ID NO: 26193 - RNA, 23 nt, Artificial Sequence
  Synthetic
gcuuauggcaucucaccagugug

SEQ ID NO: 26194 - RNA, 24 nt, Artificial Sequence
  Synthetic
ggcuuauggcaucucaccagugug

SEQ ID NO: 26195 - RNA, 18 nt, Artificial Sequence
  Synthetic
uuauaaaaaauaauugug

SEQ ID NO: 26196 - RNA, 19 nt, Artificial Sequence
  Synthetic
uuuauaaaaaauaauugug

SEQ ID NO: 26197 - RNA, 20 nt, Artificial Sequence
  Synthetic
uuuuauaaaaaauaauugug

SEQ ID NO: 26198 - RNA, 21 nt, Artificial Sequence
  Synthetic
uuuuuauaaaaaauaauugug

SEQ ID NO: 26199 - RNA, 22 nt, Artificial Sequence
  Synthetic
auuuuuauaaaaaauaauugug

SEQ ID NO: 26200 - RNA, 23 nt, Artificial Sequence
  Synthetic
gauuuuuauaaaaaauaauugug

SEQ ID NO: 26201 - RNA, 24 nt, Artificial Sequence
  Synthetic
agauuuuuauaaaaaauaauugug

SEQ ID NO: 26202 - RNA, 18 nt, Artificial Sequence
  Synthetic
gcaguuuuauuaaaauug

SEQ ID NO: 26203 - RNA, 19 nt, Artificial Sequence
  Synthetic
ggcaguuuuauuaaaauug

SEQ ID NO: 26204 - RNA, 20 nt, Artificial Sequence
  Synthetic
aggcaguuuuauuaaaauug

SEQ ID NO: 26205 - RNA, 21 nt, Artificial Sequence
  Synthetic
caggcaguuuuauuaaaauug

SEQ ID NO: 26206 - RNA, 22 nt, Artificial Sequence
  Synthetic
ucaggcaguuuuauuaaaauug

SEQ ID NO: 26207 - RNA, 23 nt, Artificial Sequence
  Synthetic
uucaggcaguuuuauuaaaauug

SEQ ID NO: 26208 - RNA, 24 nt, Artificial Sequence
  Synthetic
uuucaggcaguuuuauuaaaauug

SEQ ID NO: 26209 - RNA, 18 nt, Artificial Sequence
  Synthetic
gcucucuuuuaacuauug

SEQ ID NO: 26210 - RNA, 19 nt, Artificial Sequence
  Synthetic
ugcucucuuuuaacuauug

SEQ ID NO: 26211 - RNA, 21 nt, Artificial Sequence
  Synthetic
cuugcucucuuuuaacuauug

SEQ ID NO: 26212 - RNA, 22 nt, Artificial Sequence
  Synthetic
acuugcucucuuuuaacuauug

SEQ ID NO: 26213 - RNA, 23 nt, Artificial Sequence
  Synthetic
aacuugcucucuuuuaacuauug

SEQ ID NO: 26214 - RNA, 24 nt, Artificial Sequence
  Synthetic
aaacuugcucucuuuuaacuauug

SEQ ID NO: 26215 - RNA, 18 nt, Artificial Sequence
  Synthetic
cauuugaacaaagacuug

SEQ ID NO: 26216 - RNA, 19 nt, Artificial Sequence
  Synthetic
acauuugaacaaagacuug

SEQ ID NO: 26217 - RNA, 20 nt, Artificial Sequence
  Synthetic
aacauuugaacaaagacuug

SEQ ID NO: 26218 - RNA, 21 nt, Artificial Sequence
  Synthetic
uaacauuugaacaaagacuug

SEQ ID NO: 26219 - RNA, 22 nt, Artificial Sequence
  Synthetic
guaacauuugaacaaagacuug

SEQ ID NO: 26220 - RNA, 23 nt, Artificial Sequence
  Synthetic
gguaacauuugaacaaagacuug

SEQ ID NO: 26221 - RNA, 24 nt, Artificial Sequence
  Synthetic
agguaacauuugaacaaagacuug

SEQ ID NO: 26222 - RNA, 18 nt, Artificial Sequence
  Synthetic
uuuagcugugguacuuug

SEQ ID NO: 26223 - RNA, 19 nt, Artificial Sequence
  Synthetic
uuuuagcugugguacuuug

SEQ ID NO: 26224 - RNA, 20 nt, Artificial Sequence
  Synthetic
auuuuagcugugguacuuug

SEQ ID NO: 26225 - RNA, 21 nt, Artificial Sequence
  Synthetic
cauuuuagcugugguacuuug

SEQ ID NO: 26226 - RNA, 22 nt, Artificial Sequence
  Synthetic
ucauuuuagcugugguacuuug

SEQ ID NO: 26227 - RNA, 23 nt, Artificial Sequence
  Synthetic
gucauuuuagcugugguacuuug

SEQ ID NO: 26228 - RNA, 24 nt, Artificial Sequence
  Synthetic
ugucauuuuagcugugguacuuug

SEQ ID NO: 26229 - RNA, 18 nt, Artificial Sequence
  Synthetic
gauucaggacaugcuuug

SEQ ID NO: 26230 - RNA, 19 nt, Artificial Sequence
  Synthetic
agauucaggacaugcuuug

SEQ ID NO: 26231 - RNA, 20 nt, Artificial Sequence
  Synthetic
cagauucaggacaugcuuug

SEQ ID NO: 26232 - RNA, 21 nt, Artificial Sequence
  Synthetic
ucagauucaggacaugcuuug

SEQ ID NO: 26233 - RNA, 22 nt, Artificial Sequence
  Synthetic
aucagauucaggacaugcuuug

SEQ ID NO: 26234 - RNA, 23 nt, Artificial Sequence
  Synthetic
gaucagauucaggacaugcuuug

SEQ ID NO: 26235 - RNA, 24 nt, Artificial Sequence
  Synthetic
ugaucagauucaggacaugcuuug

SEQ ID NO: 26236 - RNA, 18 nt, Artificial Sequence
  Synthetic
cuauaccugucugguuug

SEQ ID NO: 26237 - RNA, 19 nt, Artificial Sequence
  Synthetic
acuauaccugucugguuug

SEQ ID NO: 26238 - RNA, 20 nt, Artificial Sequence
  Synthetic
gacuauaccugucugguuug

SEQ ID NO: 26239 - RNA, 21 nt, Artificial Sequence
  Synthetic
ugacuauaccugucugguuug

SEQ ID NO: 26240 - RNA, 22 nt, Artificial Sequence
  Synthetic
cugacuauaccugucugguuug

SEQ ID NO: 26241 - RNA, 23 nt, Artificial Sequence
  Synthetic
acugacuauaccugucugguuug

SEQ ID NO: 26242 - RNA, 24 nt, Artificial Sequence
  Synthetic
gacugacuauaccugucugguuug

SEQ ID NO: 26243 - RNA, 18 nt, Artificial Sequence
  Synthetic
cuuacccaaauauguuug

SEQ ID NO: 26244 - RNA, 19 nt, Artificial Sequence
  Synthetic
acuuacccaaauauguuug

SEQ ID NO: 26245 - RNA, 20 nt, Artificial Sequence
  Synthetic
aacuuacccaaauauguuug

SEQ ID NO: 26246 - RNA, 21 nt, Artificial Sequence
  Synthetic
uaacuuacccaaauauguuug

SEQ ID NO: 26247 - RNA, 22 nt, Artificial Sequence
  Synthetic
auaacuuacccaaauauguuug

SEQ ID NO: 26248 - RNA, 23 nt, Artificial Sequence
  Synthetic
uauaacuuacccaaauauguuug

SEQ ID NO: 26249 - RNA, 24 nt, Artificial Sequence
  Synthetic
cuauaacuuacccaaauauguuug

SEQ ID NO: 26250 - RNA, 18 nt, Artificial Sequence
  Synthetic
uuacccaauaaaaaaaau

SEQ ID NO: 26251 - RNA, 19 nt, Artificial Sequence
  Synthetic
guuacccaauaaaaaaaau

SEQ ID NO: 26252 - RNA, 20 nt, Artificial Sequence
  Synthetic
uguuacccaauaaaaaaaau

SEQ ID NO: 26253 - RNA, 21 nt, Artificial Sequence
  Synthetic
uuguuacccaauaaaaaaaau

SEQ ID NO: 26254 - RNA, 22 nt, Artificial Sequence
  Synthetic
auuguuacccaauaaaaaaaau

SEQ ID NO: 26255 - RNA, 23 nt, Artificial Sequence
  Synthetic
uauuguuacccaauaaaaaaaau

SEQ ID NO: 26256 - RNA, 24 nt, Artificial Sequence
  Synthetic
uuauuguuacccaauaaaaaaaau

SEQ ID NO: 26257 - RNA, 18 nt, Artificial Sequence
  Synthetic
uuuugcaaaauacaaaau

SEQ ID NO: 26258 - RNA, 19 nt, Artificial Sequence
  Synthetic
uuuuugcaaaauacaaaau

SEQ ID NO: 26259 - RNA, 20 nt, Artificial Sequence
  Synthetic
cuuuuugcaaaauacaaaau

SEQ ID NO: 26260 - RNA, 21 nt, Artificial Sequence
  Synthetic
acuuuuugcaaaauacaaaau

SEQ ID NO: 26261 - RNA, 22 nt, Artificial Sequence
  Synthetic
cacuuuuugcaaaauacaaaau

SEQ ID NO: 26262 - RNA, 23 nt, Artificial Sequence
  Synthetic
gcacuuuuugcaaaauacaaaau

SEQ ID NO: 26263 - RNA, 24 nt, Artificial Sequence
  Synthetic
ugcacuuuuugcaaaauacaaaau

SEQ ID NO: 26264 - RNA, 18 nt, Artificial Sequence
  Synthetic
aacaaaagaaaagaaaau

SEQ ID NO: 26265 - RNA, 19 nt, Artificial Sequence
  Synthetic
uaacaaaagaaaagaaaau

SEQ ID NO: 26266 - RNA, 20 nt, Artificial Sequence
  Synthetic
guaacaaaagaaaagaaaau

SEQ ID NO: 26267 - RNA, 21 nt, Artificial Sequence
  Synthetic
uguaacaaaagaaaagaaaau

SEQ ID NO: 26268 - RNA, 22 nt, Artificial Sequence
  Synthetic
uuguaacaaaagaaaagaaaau

SEQ ID NO: 26269 - RNA, 23 nt, Artificial Sequence
  Synthetic
guuguaacaaaagaaaagaaaau

SEQ ID NO: 26270 - RNA, 24 nt, Artificial Sequence
  Synthetic
uguuguaacaaaagaaaagaaaau

SEQ ID NO: 26271 - RNA, 18 nt, Artificial Sequence
  Synthetic
gacaugaaagaaucaaau

SEQ ID NO: 26272 - RNA, 19 nt, Artificial Sequence
  Synthetic
agacaugaaagaaucaaau

SEQ ID NO: 26273 - RNA, 20 nt, Artificial Sequence
  Synthetic
aagacaugaaagaaucaaau

SEQ ID NO: 26274 - RNA, 21 nt, Artificial Sequence
  Synthetic
aaagacaugaaagaaucaaau

SEQ ID NO: 26275 - RNA, 22 nt, Artificial Sequence
  Synthetic
uaaagacaugaaagaaucaaau

SEQ ID NO: 26276 - RNA, 23 nt, Artificial Sequence
  Synthetic
uuaaagacaugaaagaaucaaau

SEQ ID NO: 26277 - RNA, 24 nt, Artificial Sequence
  Synthetic
uuuaaagacaugaaagaaucaaau

SEQ ID NO: 26278 - RNA, 18 nt, Artificial Sequence
  Synthetic
gugguacuuuguagaaau

SEQ ID NO: 26279 - RNA, 19 nt, Artificial Sequence
  Synthetic
ugugguacuuuguagaaau

SEQ ID NO: 26280 - RNA, 20 nt, Artificial Sequence
  Synthetic
cugugguacuuuguagaaau

SEQ ID NO: 26281 - RNA, 21 nt, Artificial Sequence
  Synthetic
gcugugguacuuuguagaaau

SEQ ID NO: 26282 - RNA, 22 nt, Artificial Sequence
  Synthetic
agcugugguacuuuguagaaau

SEQ ID NO: 26283 - RNA, 23 nt, Artificial Sequence
  Synthetic
uagcugugguacuuuguagaaau

SEQ ID NO: 26284 - RNA, 24 nt, Artificial Sequence
  Synthetic
uuagcugugguacuuuguagaaau

SEQ ID NO: 26285 - RNA, 18 nt, Artificial Sequence
  Synthetic
aggaagaaagaaggaaau

SEQ ID NO: 26286 - RNA, 19 nt, Artificial Sequence
  Synthetic
aaggaagaaagaaggaaau

SEQ ID NO: 26287 - RNA, 20 nt, Artificial Sequence
  Synthetic
gaaggaagaaagaaggaaau

SEQ ID NO: 26288 - RNA, 21 nt, Artificial Sequence
  Synthetic
ggaaggaagaaagaaggaaau

SEQ ID NO: 26289 - RNA, 22 nt, Artificial Sequence
  Synthetic
aggaaggaagaaagaaggaaau

SEQ ID NO: 26290 - RNA, 23 nt, Artificial Sequence
  Synthetic
gaggaaggaagaaagaaggaaau

SEQ ID NO: 26291 - RNA, 24 nt, Artificial Sequence
  Synthetic
agaggaaggaagaaagaaggaaau

SEQ ID NO: 26292 - RNA, 18 nt, Artificial Sequence
  Synthetic
acuugaccagaaugaaau

SEQ ID NO: 26293 - RNA, 19 nt, Artificial Sequence
  Synthetic
aacuugaccagaaugaaau

SEQ ID NO: 26294 - RNA, 20 nt, Artificial Sequence
  Synthetic
aaacuugaccagaaugaaau

SEQ ID NO: 26295 - RNA, 21 nt, Artificial Sequence
  Synthetic
caaacuugaccagaaugaaau

SEQ ID NO: 26296 - RNA, 22 nt, Artificial Sequence
  Synthetic
ucaaacuugaccagaaugaaau

SEQ ID NO: 26297 - RNA, 23 nt, Artificial Sequence
  Synthetic
gucaaacuugaccagaaugaaau

SEQ ID NO: 26298 - RNA, 24 nt, Artificial Sequence
  Synthetic
ggucaaacuugaccagaaugaaau

SEQ ID NO: 26299 - RNA, 18 nt, Artificial Sequence
  Synthetic
accggugucuucugaaau

SEQ ID NO: 26300 - RNA, 19 nt, Artificial Sequence
  Synthetic
aaccggugucuucugaaau

SEQ ID NO: 26301 - RNA, 20 nt, Artificial Sequence
  Synthetic
uaaccggugucuucugaaau

SEQ ID NO: 26302 - RNA, 21 nt, Artificial Sequence
  Synthetic
uuaaccggugucuucugaaau

SEQ ID NO: 26303 - RNA, 22 nt, Artificial Sequence
  Synthetic
auuaaccggugucuucugaaau

SEQ ID NO: 26304 - RNA, 23 nt, Artificial Sequence
  Synthetic
aauuaaccggugucuucugaaau

SEQ ID NO: 26305 - RNA, 24 nt, Artificial Sequence
  Synthetic
uaauuaaccggugucuucugaaau

SEQ ID NO: 26306 - RNA, 18 nt, Artificial Sequence
  Synthetic
uugggguuuuuugacaau

SEQ ID NO: 26307 - RNA, 19 nt, Artificial Sequence
  Synthetic
uuugggguuuuuugacaau

SEQ ID NO: 26308 - RNA, 20 nt, Artificial Sequence
  Synthetic
uuuugggguuuuuugacaau

SEQ ID NO: 26309 - RNA, 21 nt, Artificial Sequence
  Synthetic
uuuuugggguuuuuugacaau

SEQ ID NO: 26310 - RNA, 22 nt, Artificial Sequence
  Synthetic
auuuuugggguuuuuugacaau

SEQ ID NO: 26311 - RNA, 23 nt, Artificial Sequence
  Synthetic
aauuuuugggguuuuuugacaau

SEQ ID NO: 26312 - RNA, 24 nt, Artificial Sequence
  Synthetic
aaauuuuugggguuuuuugacaau

SEQ ID NO: 26313 - RNA, 18 nt, Artificial Sequence
  Synthetic
aaugaaauuagaaagaau

SEQ ID NO: 26314 - RNA, 19 nt, Artificial Sequence
  Synthetic
gaaugaaauuagaaagaau

SEQ ID NO: 26315 - RNA, 20 nt, Artificial Sequence
  Synthetic
agaaugaaauuagaaagaau

SEQ ID NO: 26316 - RNA, 21 nt, Artificial Sequence
  Synthetic
cagaaugaaauuagaaagaau

SEQ ID NO: 26317 - RNA, 22 nt, Artificial Sequence
  Synthetic
ccagaaugaaauuagaaagaau

SEQ ID NO: 26318 - RNA, 23 nt, Artificial Sequence
  Synthetic
accagaaugaaauuagaaagaau

SEQ ID NO: 26319 - RNA, 24 nt, Artificial Sequence
  Synthetic
gaccagaaugaaauuagaaagaau

SEQ ID NO: 26320 - RNA, 18 nt, Artificial Sequence
  Synthetic
uauuuugaagaauugaau

SEQ ID NO: 26321 - RNA, 19 nt, Artificial Sequence
  Synthetic
auauuuugaagaauugaau

SEQ ID NO: 26322 - RNA, 20 nt, Artificial Sequence
  Synthetic
cauauuuugaagaauugaau

SEQ ID NO: 26323 - RNA, 21 nt, Artificial Sequence
  Synthetic
ccauauuuugaagaauugaau

SEQ ID NO: 26324 - RNA, 22 nt, Artificial Sequence
  Synthetic
accauauuuugaagaauugaau

SEQ ID NO: 26325 - RNA, 23 nt, Artificial Sequence
  Synthetic
aaccauauuuugaagaauugaau

SEQ ID NO: 26326 - RNA, 24 nt, Artificial Sequence
  Synthetic
gaaccauauuuugaagaauugaau

SEQ ID NO: 26327 - RNA, 18 nt, Artificial Sequence
  Synthetic
ugguacuacuguaauaau

SEQ ID NO: 26328 - RNA, 19 nt, Artificial Sequence
  Synthetic
augguacuacuguaauaau

SEQ ID NO: 26329 - RNA, 20 nt, Artificial Sequence
  Synthetic
uaugguacuacuguaauaau

SEQ ID NO: 26330 - RNA, 21 nt, Artificial Sequence
  Synthetic
auaugguacuacuguaauaau

SEQ ID NO: 26331 - RNA, 22 nt, Artificial Sequence
  Synthetic
cauaugguacuacuguaauaau

SEQ ID NO: 26332 - RNA, 23 nt, Artificial Sequence
  Synthetic
acauaugguacuacuguaauaau

SEQ ID NO: 26333 - RNA, 24 nt, Artificial Sequence
  Synthetic
uacauaugguacuacuguaauaau

SEQ ID NO: 26334 - RNA, 18 nt, Artificial Sequence
  Synthetic
guuuacuagaaagauaau

SEQ ID NO: 26335 - RNA, 19 nt, Artificial Sequence
  Synthetic
cguuuacuagaaagauaau

SEQ ID NO: 26336 - RNA, 21 nt, Artificial Sequence
  Synthetic
gccguuuacuagaaagauaau

SEQ ID NO: 26337 - RNA, 22 nt, Artificial Sequence
  Synthetic
ugccguuuacuagaaagauaau

SEQ ID NO: 26338 - RNA, 23 nt, Artificial Sequence
  Synthetic
gugccguuuacuagaaagauaau

SEQ ID NO: 26339 - RNA, 24 nt, Artificial Sequence
  Synthetic
ugugccguuuacuagaaagauaau

SEQ ID NO: 26340 - RNA, 18 nt, Artificial Sequence
  Synthetic
ugacucuaguucacuaau

SEQ ID NO: 26341 - RNA, 19 nt, Artificial Sequence
  Synthetic
gugacucuaguucacuaau

SEQ ID NO: 26342 - RNA, 20 nt, Artificial Sequence
  Synthetic
ugugacucuaguucacuaau

SEQ ID NO: 26343 - RNA, 21 nt, Artificial Sequence
  Synthetic
augugacucuaguucacuaau

SEQ ID NO: 26344 - RNA, 22 nt, Artificial Sequence
  Synthetic
uaugugacucuaguucacuaau

SEQ ID NO: 26345 - RNA, 23 nt, Artificial Sequence
  Synthetic
cuaugugacucuaguucacuaau

SEQ ID NO: 26346 - RNA, 24 nt, Artificial Sequence
  Synthetic
ucuaugugacucuaguucacuaau

SEQ ID NO: 26347 - RNA, 18 nt, Artificial Sequence
  Synthetic
aacauugaaagguaacau

SEQ ID NO: 26348 - RNA, 19 nt, Artificial Sequence
  Synthetic
aaacauugaaagguaacau

SEQ ID NO: 26349 - RNA, 20 nt, Artificial Sequence
  Synthetic
uaaacauugaaagguaacau

SEQ ID NO: 26350 - RNA, 21 nt, Artificial Sequence
  Synthetic
uuaaacauugaaagguaacau

SEQ ID NO: 26351 - RNA, 22 nt, Artificial Sequence
  Synthetic
uuuaaacauugaaagguaacau

SEQ ID NO: 26352 - RNA, 23 nt, Artificial Sequence
  Synthetic
cuuuaaacauugaaagguaacau

SEQ ID NO: 26353 - RNA, 24 nt, Artificial Sequence
  Synthetic
ccuuuaaacauugaaagguaacau

SEQ ID NO: 26354 - RNA, 18 nt, Artificial Sequence
  Synthetic
uuuuuucaguuaauacau

SEQ ID NO: 26355 - RNA, 19 nt, Artificial Sequence
  Synthetic
uuuuuuucaguuaauacau

SEQ ID NO: 26356 - RNA, 21 nt, Artificial Sequence
  Synthetic
auuuuuuuucaguuaauacau

SEQ ID NO: 26357 - RNA, 22 nt, Artificial Sequence
  Synthetic
aauuuuuuuucaguuaauacau

SEQ ID NO: 26358 - RNA, 23 nt, Artificial Sequence
  Synthetic
gaauuuuuuuucaguuaauacau

SEQ ID NO: 26359 - RNA, 24 nt, Artificial Sequence
  Synthetic
ugaauuuuuuuucaguuaauacau

SEQ ID NO: 26360 - RNA, 18 nt, Artificial Sequence
  Synthetic
gcauauuuggagauacau

SEQ ID NO: 26361 - RNA, 19 nt, Artificial Sequence
  Synthetic
ggcauauuuggagauacau

SEQ ID NO: 26362 - RNA, 20 nt, Artificial Sequence
  Synthetic
uggcauauuuggagauacau

SEQ ID NO: 26363 - RNA, 21 nt, Artificial Sequence
  Synthetic
cuggcauauuuggagauacau

SEQ ID NO: 26364 - RNA, 22 nt, Artificial Sequence
  Synthetic
ccuggcauauuuggagauacau

SEQ ID NO: 26365 - RNA, 23 nt, Artificial Sequence
  Synthetic
accuggcauauuuggagauacau

SEQ ID NO: 26366 - RNA, 24 nt, Artificial Sequence
  Synthetic
aaccuggcauauuuggagauacau

SEQ ID NO: 26367 - RNA, 18 nt, Artificial Sequence
  Synthetic
ccaguuguuuuccuacau

SEQ ID NO: 26368 - RNA, 19 nt, Artificial Sequence
  Synthetic
uccaguuguuuuccuacau

SEQ ID NO: 26369 - RNA, 20 nt, Artificial Sequence
  Synthetic
cuccaguuguuuuccuacau

SEQ ID NO: 26370 - RNA, 21 nt, Artificial Sequence
  Synthetic
ucuccaguuguuuuccuacau

SEQ ID NO: 26371 - RNA, 22 nt, Artificial Sequence
  Synthetic
cucuccaguuguuuuccuacau

SEQ ID NO: 26372 - RNA, 23 nt, Artificial Sequence
  Synthetic
ucucuccaguuguuuuccuacau

SEQ ID NO: 26373 - RNA, 24 nt, Artificial Sequence
  Synthetic
cucucuccaguuguuuuccuacau

SEQ ID NO: 26374 - RNA, 18 nt, Artificial Sequence
  Synthetic
cucaccccuuucugccau

SEQ ID NO: 26375 - RNA, 19 nt, Artificial Sequence
  Synthetic
ccucaccccuuucugccau

SEQ ID NO: 26376 - RNA, 20 nt, Artificial Sequence
  Synthetic
cccucaccccuuucugccau

SEQ ID NO: 26377 - RNA, 21 nt, Artificial Sequence
  Synthetic
acccucaccccuuucugccau

SEQ ID NO: 26378 - RNA, 22 nt, Artificial Sequence
  Synthetic
gacccucaccccuuucugccau

SEQ ID NO: 26379 - RNA, 23 nt, Artificial Sequence
  Synthetic
agacccucaccccuuucugccau

SEQ ID NO: 26380 - RNA, 24 nt, Artificial Sequence
  Synthetic
gagacccucaccccuuucugccau

SEQ ID NO: 26381 - RNA, 18 nt, Artificial Sequence
  Synthetic
uaaguugaacaauggcau

SEQ ID NO: 26382 - RNA, 19 nt, Artificial Sequence
  Synthetic
auaaguugaacaauggcau

SEQ ID NO: 26383 - RNA, 20 nt, Artificial Sequence
  Synthetic
gauaaguugaacaauggcau

SEQ ID NO: 26384 - RNA, 21 nt, Artificial Sequence
  Synthetic
ggauaaguugaacaauggcau

SEQ ID NO: 26385 - RNA, 22 nt, Artificial Sequence
  Synthetic
uggauaaguugaacaauggcau

SEQ ID NO: 26386 - RNA, 23 nt, Artificial Sequence
  Synthetic
auggauaaguugaacaauggcau

SEQ ID NO: 26387 - RNA, 24 nt, Artificial Sequence
  Synthetic
aauggauaaguugaacaauggcau

SEQ ID NO: 26388 - RNA, 18 nt, Artificial Sequence
  Synthetic
aaaauaucaccaacucau

SEQ ID NO: 26389 - RNA, 19 nt, Artificial Sequence
  Synthetic
aaaaauaucaccaacucau

SEQ ID NO: 26390 - RNA, 20 nt, Artificial Sequence
  Synthetic
gaaaaauaucaccaacucau

SEQ ID NO: 26391 - RNA, 21 nt, Artificial Sequence
  Synthetic
ugaaaaauaucaccaacucau

SEQ ID NO: 26392 - RNA, 22 nt, Artificial Sequence
  Synthetic
augaaaaauaucaccaacucau

SEQ ID NO: 26393 - RNA, 23 nt, Artificial Sequence
  Synthetic
aaugaaaaauaucaccaacucau

SEQ ID NO: 26394 - RNA, 24 nt, Artificial Sequence
  Synthetic
uaaugaaaaauaucaccaacucau

SEQ ID NO: 26395 - RNA, 18 nt, Artificial Sequence
  Synthetic
uuuguaaauuuguuucau

SEQ ID NO: 26396 - RNA, 19 nt, Artificial Sequence
  Synthetic
uuuuguaaauuuguuucau

SEQ ID NO: 26397 - RNA, 20 nt, Artificial Sequence
  Synthetic
auuuuguaaauuuguuucau

SEQ ID NO: 26398 - RNA, 21 nt, Artificial Sequence
  Synthetic
aauuuuguaaauuuguuucau

SEQ ID NO: 26399 - RNA, 22 nt, Artificial Sequence
  Synthetic
uaauuuuguaaauuuguuucau

SEQ ID NO: 26400 - RNA, 23 nt, Artificial Sequence
  Synthetic
cuaauuuuguaaauuuguuucau

SEQ ID NO: 26401 - RNA, 24 nt, Artificial Sequence
  Synthetic
acuaauuuuguaaauuuguuucau

SEQ ID NO: 26402 - RNA, 18 nt, Artificial Sequence
  Synthetic
uuuaucaauaucuaagau

SEQ ID NO: 26403 - RNA, 19 nt, Artificial Sequence
  Synthetic
auuuaucaauaucuaagau

SEQ ID NO: 26404 - RNA, 20 nt, Artificial Sequence
  Synthetic
uauuuaucaauaucuaagau

SEQ ID NO: 26405 - RNA, 21 nt, Artificial Sequence
  Synthetic
uuauuuaucaauaucuaagau

SEQ ID NO: 26406 - RNA, 22 nt, Artificial Sequence
  Synthetic
auuauuuaucaauaucuaagau

SEQ ID NO: 26407 - RNA, 23 nt, Artificial Sequence
  Synthetic
aauuauuuaucaauaucuaagau

SEQ ID NO: 26408 - RNA, 24 nt, Artificial Sequence
  Synthetic
caauuauuuaucaauaucuaagau

SEQ ID NO: 26409 - RNA, 18 nt, Artificial Sequence
  Synthetic
aagaaucaaauuagagau

SEQ ID NO: 26410 - RNA, 19 nt, Artificial Sequence
  Synthetic
aaagaaucaaauuagagau

SEQ ID NO: 26411 - RNA, 20 nt, Artificial Sequence
  Synthetic
gaaagaaucaaauuagagau

SEQ ID NO: 26412 - RNA, 21 nt, Artificial Sequence
  Synthetic
ugaaagaaucaaauuagagau

SEQ ID NO: 26413 - RNA, 22 nt, Artificial Sequence
  Synthetic
augaaagaaucaaauuagagau

SEQ ID NO: 26414 - RNA, 23 nt, Artificial Sequence
  Synthetic
caugaaagaaucaaauuagagau

SEQ ID NO: 26415 - RNA, 24 nt, Artificial Sequence
  Synthetic
acaugaaagaaucaaauuagagau

SEQ ID NO: 26416 - RNA, 18 nt, Artificial Sequence
  Synthetic
uuuggaauuuugggagau

SEQ ID NO: 26417 - RNA, 19 nt, Artificial Sequence
  Synthetic
uuuuggaauuuugggagau

SEQ ID NO: 26418 - RNA, 20 nt, Artificial Sequence
  Synthetic
auuuuggaauuuugggagau

SEQ ID NO: 26419 - RNA, 21 nt, Artificial Sequence
  Synthetic
uauuuuggaauuuugggagau

SEQ ID NO: 26420 - RNA, 22 nt, Artificial Sequence
  Synthetic
auauuuuggaauuuugggagau

SEQ ID NO: 26421 - RNA, 23 nt, Artificial Sequence
  Synthetic
aauauuuuggaauuuugggagau

SEQ ID NO: 26422 - RNA, 24 nt, Artificial Sequence
  Synthetic
caauauuuuggaauuuugggagau

SEQ ID NO: 26423 - RNA, 18 nt, Artificial Sequence
  Synthetic
uauuucucugggugagau

SEQ ID NO: 26424 - RNA, 19 nt, Artificial Sequence
  Synthetic
uuauuucucugggugagau

SEQ ID NO: 26425 - RNA, 20 nt, Artificial Sequence
  Synthetic
cuuauuucucugggugagau

SEQ ID NO: 26426 - RNA, 21 nt, Artificial Sequence
  Synthetic
gcuuauuucucugggugagau

SEQ ID NO: 26427 - RNA, 22 nt, Artificial Sequence
  Synthetic
ggcuuauuucucugggugagau

SEQ ID NO: 26428 - RNA, 23 nt, Artificial Sequence
  Synthetic
aggcuuauuucucugggugagau

SEQ ID NO: 26429 - RNA, 24 nt, Artificial Sequence
  Synthetic
aaggcuuauuucucugggugagau

SEQ ID NO: 26430 - RNA, 18 nt, Artificial Sequence
  Synthetic
ucugaaaaaauaguagau

SEQ ID NO: 26431 - RNA, 19 nt, Artificial Sequence
  Synthetic
aucugaaaaaauaguagau

SEQ ID NO: 26432 - RNA, 20 nt, Artificial Sequence
  Synthetic
caucugaaaaaauaguagau

SEQ ID NO: 26433 - RNA, 21 nt, Artificial Sequence
  Synthetic
acaucugaaaaaauaguagau

SEQ ID NO: 26434 - RNA, 22 nt, Artificial Sequence
  Synthetic
uacaucugaaaaaauaguagau

SEQ ID NO: 26435 - RNA, 23 nt, Artificial Sequence
  Synthetic
auacaucugaaaaaauaguagau

SEQ ID NO: 26436 - RNA, 24 nt, Artificial Sequence
  Synthetic
gauacaucugaaaaaauaguagau

SEQ ID NO: 26437 - RNA, 18 nt, Artificial Sequence
  Synthetic
uugcaggaggugagggau

SEQ ID NO: 26438 - RNA, 19 nt, Artificial Sequence
  Synthetic
cuugcaggaggugagggau

SEQ ID NO: 26439 - RNA, 20 nt, Artificial Sequence
  Synthetic
acuugcaggaggugagggau

SEQ ID NO: 26440 - RNA, 21 nt, Artificial Sequence
  Synthetic
gacuugcaggaggugagggau

SEQ ID NO: 26441 - RNA, 22 nt, Artificial Sequence
  Synthetic
agacuugcaggaggugagggau

SEQ ID NO: 26442 - RNA, 23 nt, Artificial Sequence
  Synthetic
aagacuugcaggaggugagggau

SEQ ID NO: 26443 - RNA, 24 nt, Artificial Sequence
  Synthetic
aaagacuugcaggaggugagggau

SEQ ID NO: 26444 - RNA, 18 nt, Artificial Sequence
  Synthetic
aaaggaaagaggguugau

SEQ ID NO: 26445 - RNA, 19 nt, Artificial Sequence
  Synthetic
uaaaggaaagaggguugau

SEQ ID NO: 26446 - RNA, 20 nt, Artificial Sequence
  Synthetic
cuaaaggaaagaggguugau

SEQ ID NO: 26447 - RNA, 21 nt, Artificial Sequence
  Synthetic
ucuaaaggaaagaggguugau

SEQ ID NO: 26448 - RNA, 22 nt, Artificial Sequence
  Synthetic
uucuaaaggaaagaggguugau

SEQ ID NO: 26449 - RNA, 23 nt, Artificial Sequence
  Synthetic
auucuaaaggaaagaggguugau

SEQ ID NO: 26450 - RNA, 24 nt, Artificial Sequence
  Synthetic
gauucuaaaggaaagaggguugau

SEQ ID NO: 26451 - RNA, 18 nt, Artificial Sequence
  Synthetic
aguugaacaauggcauau

SEQ ID NO: 26452 - RNA, 19 nt, Artificial Sequence
  Synthetic
aaguugaacaauggcauau

SEQ ID NO: 26453 - RNA, 20 nt, Artificial Sequence
  Synthetic
uaaguugaacaauggcauau

SEQ ID NO: 26454 - RNA, 21 nt, Artificial Sequence
  Synthetic
auaaguugaacaauggcauau

SEQ ID NO: 26455 - RNA, 22 nt, Artificial Sequence
  Synthetic
gauaaguugaacaauggcauau

SEQ ID NO: 26456 - RNA, 23 nt, Artificial Sequence
  Synthetic
ggauaaguugaacaauggcauau

SEQ ID NO: 26457 - RNA, 24 nt, Artificial Sequence
  Synthetic
uggauaaguugaacaauggcauau

SEQ ID NO: 26458 - RNA, 18 nt, Artificial Sequence
  Synthetic
caacuuaaccuggcauau

SEQ ID NO: 26459 - RNA, 19 nt, Artificial Sequence
  Synthetic
acaacuuaaccuggcauau

SEQ ID NO: 26460 - RNA, 20 nt, Artificial Sequence
  Synthetic
aacaacuuaaccuggcauau

SEQ ID NO: 26461 - RNA, 21 nt, Artificial Sequence
  Synthetic
gaacaacuuaaccuggcauau

SEQ ID NO: 26462 - RNA, 22 nt, Artificial Sequence
  Synthetic
agaacaacuuaaccuggcauau

SEQ ID NO: 26463 - RNA, 23 nt, Artificial Sequence
  Synthetic
aagaacaacuuaaccuggcauau

SEQ ID NO: 26464 - RNA, 24 nt, Artificial Sequence
  Synthetic
uaagaacaacuuaaccuggcauau

SEQ ID NO: 26465 - RNA, 18 nt, Artificial Sequence
  Synthetic
auuaaaaaauuauacuau

SEQ ID NO: 26466 - RNA, 19 nt, Artificial Sequence
  Synthetic
uauuaaaaaauuauacuau

SEQ ID NO: 26467 - RNA, 21 nt, Artificial Sequence
  Synthetic
acuauuaaaaaauuauacuau

SEQ ID NO: 26468 - RNA, 22 nt, Artificial Sequence
  Synthetic
cacuauuaaaaaauuauacuau

SEQ ID NO: 26469 - RNA, 23 nt, Artificial Sequence
  Synthetic
ucacuauuaaaaaauuauacuau

SEQ ID NO: 26470 - RNA, 24 nt, Artificial Sequence
  Synthetic
uucacuauuaaaaaauuauacuau

SEQ ID NO: 26471 - RNA, 18 nt, Artificial Sequence
  Synthetic
uuuauaaagcuguacuau

SEQ ID NO: 26472 - RNA, 19 nt, Artificial Sequence
  Synthetic
guuuauaaagcuguacuau

SEQ ID NO: 26473 - RNA, 20 nt, Artificial Sequence
  Synthetic
gguuuauaaagcuguacuau

SEQ ID NO: 26474 - RNA, 21 nt, Artificial Sequence
  Synthetic
agguuuauaaagcuguacuau

SEQ ID NO: 26475 - RNA, 22 nt, Artificial Sequence
  Synthetic
uagguuuauaaagcuguacuau

SEQ ID NO: 26476 - RNA, 23 nt, Artificial Sequence
  Synthetic
uuagguuuauaaagcuguacuau

SEQ ID NO: 26477 - RNA, 24 nt, Artificial Sequence
  Synthetic
uuuagguuuauaaagcuguacuau

SEQ ID NO: 26478 - RNA, 18 nt, Artificial Sequence
  Synthetic
uaagggcauucuaaguau

SEQ ID NO: 26479 - RNA, 19 nt, Artificial Sequence
  Synthetic
cuaagggcauucuaaguau

SEQ ID NO: 26480 - RNA, 20 nt, Artificial Sequence
  Synthetic
ccuaagggcauucuaaguau

SEQ ID NO: 26481 - RNA, 21 nt, Artificial Sequence
  Synthetic
gccuaagggcauucuaaguau

SEQ ID NO: 26482 - RNA, 22 nt, Artificial Sequence
  Synthetic
agccuaagggcauucuaaguau

SEQ ID NO: 26483 - RNA, 23 nt, Artificial Sequence
  Synthetic
uagccuaagggcauucuaaguau

SEQ ID NO: 26484 - RNA, 24 nt, Artificial Sequence
  Synthetic
uuagccuaagggcauucuaaguau

SEQ ID NO: 26485 - RNA, 18 nt, Artificial Sequence
  Synthetic
gcugccuuuuaguaguau

SEQ ID NO: 26486 - RNA, 19 nt, Artificial Sequence
  Synthetic
ggcugccuuuuaguaguau

SEQ ID NO: 26487 - RNA, 20 nt, Artificial Sequence
  Synthetic
aggcugccuuuuaguaguau

SEQ ID NO: 26488 - RNA, 21 nt, Artificial Sequence
  Synthetic
gaggcugccuuuuaguaguau

SEQ ID NO: 26489 - RNA, 22 nt, Artificial Sequence
  Synthetic
ggaggcugccuuuuaguaguau

SEQ ID NO: 26490 - RNA, 23 nt, Artificial Sequence
  Synthetic
aggaggcugccuuuuaguaguau

SEQ ID NO: 26491 - RNA, 24 nt, Artificial Sequence
  Synthetic
uaggaggcugccuuuuaguaguau

SEQ ID NO: 26492 - RNA, 18 nt, Artificial Sequence
  Synthetic
cuuuuucauugaauguau

SEQ ID NO: 26493 - RNA, 19 nt, Artificial Sequence
  Synthetic
ucuuuuucauugaauguau

SEQ ID NO: 26494 - RNA, 20 nt, Artificial Sequence
  Synthetic
uucuuuuucauugaauguau

SEQ ID NO: 26495 - RNA, 21 nt, Artificial Sequence
  Synthetic
uuucuuuuucauugaauguau

SEQ ID NO: 26496 - RNA, 22 nt, Artificial Sequence
  Synthetic
uuuucuuuuucauugaauguau

SEQ ID NO: 26497 - RNA, 23 nt, Artificial Sequence
  Synthetic
cuuuucuuuuucauugaauguau

SEQ ID NO: 26498 - RNA, 24 nt, Artificial Sequence
  Synthetic
ccuuuucuuuuucauugaauguau

SEQ ID NO: 26499 - RNA, 18 nt, Artificial Sequence
  Synthetic
caauuugguaauuuguau

SEQ ID NO: 26500 - RNA, 19 nt, Artificial Sequence
  Synthetic
acaauuugguaauuuguau

SEQ ID NO: 26501 - RNA, 20 nt, Artificial Sequence
  Synthetic
uacaauuugguaauuuguau

SEQ ID NO: 26502 - RNA, 21 nt, Artificial Sequence
  Synthetic
auacaauuugguaauuuguau

SEQ ID NO: 26503 - RNA, 22 nt, Artificial Sequence
  Synthetic
aauacaauuugguaauuuguau

SEQ ID NO: 26504 - RNA, 23 nt, Artificial Sequence
  Synthetic
caauacaauuugguaauuuguau

SEQ ID NO: 26505 - RNA, 24 nt, Artificial Sequence
  Synthetic
ucaauacaauuugguaauuuguau

SEQ ID NO: 26506 - RNA, 18 nt, Artificial Sequence
  Synthetic
auuuuuaaccuggauuau

SEQ ID NO: 26507 - RNA, 19 nt, Artificial Sequence
  Synthetic
uauuuuuaaccuggauuau

SEQ ID NO: 26508 - RNA, 20 nt, Artificial Sequence
  Synthetic
auauuuuuaaccuggauuau

SEQ ID NO: 26509 - RNA, 21 nt, Artificial Sequence
  Synthetic
uauauuuuuaaccuggauuau

SEQ ID NO: 26510 - RNA, 22 nt, Artificial Sequence
  Synthetic
auauauuuuuaaccuggauuau

SEQ ID NO: 26511 - RNA, 23 nt, Artificial Sequence
  Synthetic
uauauauuuuuaaccuggauuau

SEQ ID NO: 26512 - RNA, 24 nt, Artificial Sequence
  Synthetic
auauauauuuuuaaccuggauuau

SEQ ID NO: 26513 - RNA, 18 nt, Artificial Sequence
  Synthetic
aaaaguuucucaucuuau

SEQ ID NO: 26514 - RNA, 19 nt, Artificial Sequence
  Synthetic
aaaaaguuucucaucuuau

SEQ ID NO: 26515 - RNA, 21 nt, Artificial Sequence
  Synthetic
uuaaaaaguuucucaucuuau

SEQ ID NO: 26516 - RNA, 22 nt, Artificial Sequence
  Synthetic
uuuaaaaaguuucucaucuuau

SEQ ID NO: 26517 - RNA, 23 nt, Artificial Sequence
  Synthetic
auuuaaaaaguuucucaucuuau

SEQ ID NO: 26518 - RNA, 24 nt, Artificial Sequence
  Synthetic
aauuuaaaaaguuucucaucuuau

SEQ ID NO: 26519 - RNA, 18 nt, Artificial Sequence
  Synthetic
uucccagccuccagaacu

SEQ ID NO: 26520 - RNA, 19 nt, Artificial Sequence
  Synthetic
cuucccagccuccagaacu

SEQ ID NO: 26521 - RNA, 20 nt, Artificial Sequence
  Synthetic
acuucccagccuccagaacu

SEQ ID NO: 26522 - RNA, 21 nt, Artificial Sequence
  Synthetic
gacuucccagccuccagaacu

SEQ ID NO: 26523 - RNA, 22 nt, Artificial Sequence
  Synthetic
ggacuucccagccuccagaacu

SEQ ID NO: 26524 - RNA, 23 nt, Artificial Sequence
  Synthetic
uggacuucccagccuccagaacu

SEQ ID NO: 26525 - RNA, 24 nt, Artificial Sequence
  Synthetic
uuggacuucccagccuccagaacu

SEQ ID NO: 26526 - RNA, 18 nt, Artificial Sequence
  Synthetic
gauuagggaaugcagacu

SEQ ID NO: 26527 - RNA, 19 nt, Artificial Sequence
  Synthetic
ggauuagggaaugcagacu

SEQ ID NO: 26528 - RNA, 20 nt, Artificial Sequence
  Synthetic
gggauuagggaaugcagacu

SEQ ID NO: 26529 - RNA, 21 nt, Artificial Sequence
  Synthetic
agggauuagggaaugcagacu

SEQ ID NO: 26530 - RNA, 22 nt, Artificial Sequence
  Synthetic
gagggauuagggaaugcagacu

SEQ ID NO: 26531 - RNA, 23 nt, Artificial Sequence
  Synthetic
ugagggauuagggaaugcagacu

SEQ ID NO: 26532 - RNA, 24 nt, Artificial Sequence
  Synthetic
gugagggauuagggaaugcagacu

SEQ ID NO: 26533 - RNA, 18 nt, Artificial Sequence
  Synthetic
agaauugaauaugagacu

SEQ ID NO: 26534 - RNA, 19 nt, Artificial Sequence
  Synthetic
aagaauugaauaugagacu

SEQ ID NO: 26535 - RNA, 21 nt, Artificial Sequence
  Synthetic
ugaagaauugaauaugagacu

SEQ ID NO: 26536 - RNA, 22 nt, Artificial Sequence
  Synthetic
uugaagaauugaauaugagacu

SEQ ID NO: 26537 - RNA, 23 nt, Artificial Sequence
  Synthetic
uuugaagaauugaauaugagacu

SEQ ID NO: 26538 - RNA, 24 nt, Artificial Sequence
  Synthetic
uuuugaagaauugaauaugagacu

SEQ ID NO: 26539 - RNA, 18 nt, Artificial Sequence
  Synthetic
uagauuagcuuauauacu

SEQ ID NO: 26540 - RNA, 19 nt, Artificial Sequence
  Synthetic
auagauuagcuuauauacu

SEQ ID NO: 26541 - RNA, 20 nt, Artificial Sequence
  Synthetic
aauagauuagcuuauauacu

SEQ ID NO: 26542 - RNA, 21 nt, Artificial Sequence
  Synthetic
gaauagauuagcuuauauacu

SEQ ID NO: 26543 - RNA, 22 nt, Artificial Sequence
  Synthetic
ugaauagauuagcuuauauacu

SEQ ID NO: 26544 - RNA, 23 nt, Artificial Sequence
  Synthetic
uugaauagauuagcuuauauacu

SEQ ID NO: 26545 - RNA, 24 nt, Artificial Sequence
  Synthetic
uuugaauagauuagcuuauauacu

SEQ ID NO: 26546 - RNA, 18 nt, Artificial Sequence
  Synthetic
cccguagucccagcuacu

SEQ ID NO: 26547 - RNA, 19 nt, Artificial Sequence
  Synthetic
gcccguagucccagcuacu

SEQ ID NO: 26548 - RNA, 21 nt, Artificial Sequence
  Synthetic
gugcccguagucccagcuacu

SEQ ID NO: 26549 - RNA, 22 nt, Artificial Sequence
  Synthetic
ggugcccguagucccagcuacu

SEQ ID NO: 26550 - RNA, 23 nt, Artificial Sequence
  Synthetic
gggugcccguagucccagcuacu

SEQ ID NO: 26551 - RNA, 24 nt, Artificial Sequence
  Synthetic
cgggugcccguagucccagcuacu

SEQ ID NO: 26552 - RNA, 21 nt, Artificial Sequence
  Synthetic
gugccuguagucccagcuacu

SEQ ID NO: 26553 - RNA, 22 nt, Artificial Sequence
  Synthetic
ugugccuguagucccagcuacu

SEQ ID NO: 26554 - RNA, 23 nt, Artificial Sequence
  Synthetic
gugugccuguagucccagcuacu

SEQ ID NO: 26555 - RNA, 24 nt, Artificial Sequence
  Synthetic
ugugugccuguagucccagcuacu

SEQ ID NO: 26556 - RNA, 18 nt, Artificial Sequence
  Synthetic
ucuuuauaaaagaaaccu

SEQ ID NO: 26557 - RNA, 19 nt, Artificial Sequence
  Synthetic
gucuuuauaaaagaaaccu

SEQ ID NO: 26558 - RNA, 20 nt, Artificial Sequence
  Synthetic
ugucuuuauaaaagaaaccu

SEQ ID NO: 26559 - RNA, 21 nt, Artificial Sequence
  Synthetic
gugucuuuauaaaagaaaccu

SEQ ID NO: 26560 - RNA, 22 nt, Artificial Sequence
  Synthetic
agugucuuuauaaaagaaaccu

SEQ ID NO: 26561 - RNA, 23 nt, Artificial Sequence
  Synthetic
uagugucuuuauaaaagaaaccu

SEQ ID NO: 26562 - RNA, 24 nt, Artificial Sequence
  Synthetic
uuagugucuuuauaaaagaaaccu

SEQ ID NO: 26563 - RNA, 18 nt, Artificial Sequence
  Synthetic
agagagacccucacaccu

SEQ ID NO: 26564 - RNA, 19 nt, Artificial Sequence
  Synthetic
uagagagacccucacaccu

SEQ ID NO: 26565 - RNA, 20 nt, Artificial Sequence
  Synthetic
uuagagagacccucacaccu

SEQ ID NO: 26566 - RNA, 21 nt, Artificial Sequence
  Synthetic
cuuagagagacccucacaccu

SEQ ID NO: 26567 - RNA, 22 nt, Artificial Sequence
  Synthetic
ccuuagagagacccucacaccu

SEQ ID NO: 26568 - RNA, 23 nt, Artificial Sequence
  Synthetic
accuuagagagacccucacaccu

SEQ ID NO: 26569 - RNA, 24 nt, Artificial Sequence
  Synthetic
aaccuuagagagacccucacaccu

SEQ ID NO: 26570 - RNA, 18 nt, Artificial Sequence
  Synthetic
uucuccauaucccacccu

SEQ ID NO: 26571 - RNA, 19 nt, Artificial Sequence
  Synthetic
cuucuccauaucccacccu

SEQ ID NO: 26572 - RNA, 20 nt, Artificial Sequence
  Synthetic
ucuucuccauaucccacccu

SEQ ID NO: 26573 - RNA, 21 nt, Artificial Sequence
  Synthetic
cucuucuccauaucccacccu

SEQ ID NO: 26574 - RNA, 22 nt, Artificial Sequence
  Synthetic
ccucuucuccauaucccacccu

SEQ ID NO: 26575 - RNA, 23 nt, Artificial Sequence
  Synthetic
uccucuucuccauaucccacccu

SEQ ID NO: 26576 - RNA, 24 nt, Artificial Sequence
  Synthetic
auccucuucuccauaucccacccu

SEQ ID NO: 26577 - RNA, 18 nt, Artificial Sequence
  Synthetic
aggaaggcaguggucccu

SEQ ID NO: 26578 - RNA, 19 nt, Artificial Sequence
  Synthetic
gaggaaggcaguggucccu

SEQ ID NO: 26579 - RNA, 21 nt, Artificial Sequence
  Synthetic
uagaggaaggcaguggucccu

SEQ ID NO: 26580 - RNA, 22 nt, Artificial Sequence
  Synthetic
uuagaggaaggcaguggucccu

SEQ ID NO: 26581 - RNA, 23 nt, Artificial Sequence
  Synthetic
guuagaggaaggcaguggucccu

SEQ ID NO: 26582 - RNA, 24 nt, Artificial Sequence
  Synthetic
aguuagaggaaggcaguggucccu

SEQ ID NO: 26583 - RNA, 18 nt, Artificial Sequence
  Synthetic
ggaggaucaccugagccu

SEQ ID NO: 26584 - RNA, 19 nt, Artificial Sequence
  Synthetic
gggaggaucaccugagccu

SEQ ID NO: 26585 - RNA, 20 nt, Artificial Sequence
  Synthetic
ugggaggaucaccugagccu

SEQ ID NO: 26586 - RNA, 21 nt, Artificial Sequence
  Synthetic
gugggaggaucaccugagccu

SEQ ID NO: 26587 - RNA, 22 nt, Artificial Sequence
  Synthetic
ggugggaggaucaccugagccu

SEQ ID NO: 26588 - RNA, 23 nt, Artificial Sequence
  Synthetic
aggugggaggaucaccugagccu

SEQ ID NO: 26589 - RNA, 24 nt, Artificial Sequence
  Synthetic
gaggugggaggaucaccugagccu

SEQ ID NO: 26590 - RNA, 18 nt, Artificial Sequence
  Synthetic
ggguguagggguuagccu

SEQ ID NO: 26591 - RNA, 19 nt, Artificial Sequence
  Synthetic
gggguguagggguuagccu

SEQ ID NO: 26592 - RNA, 20 nt, Artificial Sequence
  Synthetic
agggguguagggguuagccu

SEQ ID NO: 26593 - RNA, 21 nt, Artificial Sequence
  Synthetic
aagggguguagggguuagccu

SEQ ID NO: 26594 - RNA, 22 nt, Artificial Sequence
  Synthetic
aaagggguguagggguuagccu

SEQ ID NO: 26595 - RNA, 23 nt, Artificial Sequence
  Synthetic
gaaagggguguagggguuagccu

SEQ ID NO: 26596 - RNA, 24 nt, Artificial Sequence
  Synthetic
agaaagggguguagggguuagccu

SEQ ID NO: 26597 - RNA, 18 nt, Artificial Sequence
  Synthetic
uauugcaggguggggccu

SEQ ID NO: 26598 - RNA, 19 nt, Artificial Sequence
  Synthetic
guauugcaggguggggccu

SEQ ID NO: 26599 - RNA, 20 nt, Artificial Sequence
  Synthetic
gguauugcaggguggggccu

SEQ ID NO: 26600 - RNA, 21 nt, Artificial Sequence
  Synthetic
ugguauugcaggguggggccu

SEQ ID NO: 26601 - RNA, 22 nt, Artificial Sequence
  Synthetic
augguauugcaggguggggccu

SEQ ID NO: 26602 - RNA, 23 nt, Artificial Sequence
  Synthetic
gaugguauugcaggguggggccu

SEQ ID NO: 26603 - RNA, 24 nt, Artificial Sequence
  Synthetic
ugaugguauugcaggguggggccu

SEQ ID NO: 26604 - RNA, 18 nt, Artificial Sequence
  Synthetic
uuugaccuaagauauccu

SEQ ID NO: 26605 - RNA, 19 nt, Artificial Sequence
  Synthetic
cuuugaccuaagauauccu

SEQ ID NO: 26606 - RNA, 20 nt, Artificial Sequence
  Synthetic
ucuuugaccuaagauauccu

SEQ ID NO: 26607 - RNA, 21 nt, Artificial Sequence
  Synthetic
cucuuugaccuaagauauccu

SEQ ID NO: 26608 - RNA, 22 nt, Artificial Sequence
  Synthetic
ccucuuugaccuaagauauccu

SEQ ID NO: 26609 - RNA, 23 nt, Artificial Sequence
  Synthetic
uccucuuugaccuaagauauccu

SEQ ID NO: 26610 - RNA, 24 nt, Artificial Sequence
  Synthetic
uuccucuuugaccuaagauauccu

SEQ ID NO: 26611 - RNA, 18 nt, Artificial Sequence
  Synthetic
agcuuaugaaaagcagcu

SEQ ID NO: 26612 - RNA, 19 nt, Artificial Sequence
  Synthetic
uagcuuaugaaaagcagcu

SEQ ID NO: 26613 - RNA, 20 nt, Artificial Sequence
  Synthetic
auagcuuaugaaaagcagcu

SEQ ID NO: 26614 - RNA, 21 nt, Artificial Sequence
  Synthetic
uauagcuuaugaaaagcagcu

SEQ ID NO: 26615 - RNA, 22 nt, Artificial Sequence
  Synthetic
uuauagcuuaugaaaagcagcu

SEQ ID NO: 26616 - RNA, 23 nt, Artificial Sequence
  Synthetic
guuauagcuuaugaaaagcagcu

SEQ ID NO: 26617 - RNA, 24 nt, Artificial Sequence
  Synthetic
aguuauagcuuaugaaaagcagcu

SEQ ID NO: 26618 - RNA, 18 nt, Artificial Sequence
  Synthetic
agaugugcaaaaauagcu

SEQ ID NO: 26619 - RNA, 19 nt, Artificial Sequence
  Synthetic
uagaugugcaaaaauagcu

SEQ ID NO: 26620 - RNA, 20 nt, Artificial Sequence
  Synthetic
auagaugugcaaaaauagcu

SEQ ID NO: 26621 - RNA, 21 nt, Artificial Sequence
  Synthetic
gauagaugugcaaaaauagcu

SEQ ID NO: 26622 - RNA, 22 nt, Artificial Sequence
  Synthetic
ugauagaugugcaaaaauagcu

SEQ ID NO: 26623 - RNA, 23 nt, Artificial Sequence
  Synthetic
augauagaugugcaaaaauagcu

SEQ ID NO: 26624 - RNA, 24 nt, Artificial Sequence
  Synthetic
uaugauagaugugcaaaaauagcu

SEQ ID NO: 26625 - RNA, 18 nt, Artificial Sequence
  Synthetic
ucagauucaggacaugcu

SEQ ID NO: 26626 - RNA, 19 nt, Artificial Sequence
  Synthetic
aucagauucaggacaugcu

SEQ ID NO: 26627 - RNA, 20 nt, Artificial Sequence
  Synthetic
gaucagauucaggacaugcu

SEQ ID NO: 26628 - RNA, 21 nt, Artificial Sequence
  Synthetic
ugaucagauucaggacaugcu

SEQ ID NO: 26629 - RNA, 22 nt, Artificial Sequence
  Synthetic
gugaucagauucaggacaugcu

SEQ ID NO: 26630 - RNA, 23 nt, Artificial Sequence
  Synthetic
agugaucagauucaggacaugcu

SEQ ID NO: 26631 - RNA, 24 nt, Artificial Sequence
  Synthetic
aagugaucagauucaggacaugcu

SEQ ID NO: 26632 - RNA, 18 nt, Artificial Sequence
  Synthetic
aguuuacuaacucaaucu

SEQ ID NO: 26633 - RNA, 19 nt, Artificial Sequence
  Synthetic
gaguuuacuaacucaaucu

SEQ ID NO: 26634 - RNA, 21 nt, Artificial Sequence
  Synthetic
cggaguuuacuaacucaaucu

SEQ ID NO: 26635 - RNA, 22 nt, Artificial Sequence
  Synthetic
acggaguuuacuaacucaaucu

SEQ ID NO: 26636 - RNA, 23 nt, Artificial Sequence
  Synthetic
aacggaguuuacuaacucaaucu

SEQ ID NO: 26637 - RNA, 24 nt, Artificial Sequence
  Synthetic
aaacggaguuuacuaacucaaucu

SEQ ID NO: 26638 - RNA, 18 nt, Artificial Sequence
  Synthetic
uuuaucaaguuguuaucu

SEQ ID NO: 26639 - RNA, 19 nt, Artificial Sequence
  Synthetic
auuuaucaaguuguuaucu

SEQ ID NO: 26640 - RNA, 20 nt, Artificial Sequence
  Synthetic
aauuuaucaaguuguuaucu

SEQ ID NO: 26641 - RNA, 21 nt, Artificial Sequence
  Synthetic
aaauuuaucaaguuguuaucu

SEQ ID NO: 26642 - RNA, 22 nt, Artificial Sequence
  Synthetic
uaaauuuaucaaguuguuaucu

SEQ ID NO: 26643 - RNA, 23 nt, Artificial Sequence
  Synthetic
auaaauuuaucaaguuguuaucu

SEQ ID NO: 26644 - RNA, 24 nt, Artificial Sequence
  Synthetic
gauaaauuuaucaaguuguuaucu

SEQ ID NO: 26645 - RNA, 18 nt, Artificial Sequence
  Synthetic
uuagggaaugcagacucu

SEQ ID NO: 26646 - RNA, 19 nt, Artificial Sequence
  Synthetic
auuagggaaugcagacucu

SEQ ID NO: 26647 - RNA, 21 nt, Artificial Sequence
  Synthetic
ggauuagggaaugcagacucu

SEQ ID NO: 26648 - RNA, 22 nt, Artificial Sequence
  Synthetic
gggauuagggaaugcagacucu

SEQ ID NO: 26649 - RNA, 23 nt, Artificial Sequence
  Synthetic
agggauuagggaaugcagacucu

SEQ ID NO: 26650 - RNA, 24 nt, Artificial Sequence
  Synthetic
gagggauuagggaaugcagacucu

SEQ ID NO: 26651 - RNA, 18 nt, Artificial Sequence
  Synthetic
ccaauaaaauaaaagucu

SEQ ID NO: 26652 - RNA, 19 nt, Artificial Sequence
  Synthetic
cccaauaaaauaaaagucu

SEQ ID NO: 26653 - RNA, 20 nt, Artificial Sequence
  Synthetic
acccaauaaaauaaaagucu

SEQ ID NO: 26654 - RNA, 21 nt, Artificial Sequence
  Synthetic
aacccaauaaaauaaaagucu

SEQ ID NO: 26655 - RNA, 22 nt, Artificial Sequence
  Synthetic
aaacccaauaaaauaaaagucu

SEQ ID NO: 26656 - RNA, 23 nt, Artificial Sequence
  Synthetic
aaaacccaauaaaauaaaagucu

SEQ ID NO: 26657 - RNA, 24 nt, Artificial Sequence
  Synthetic
gaaaacccaauaaaauaaaagucu

SEQ ID NO: 26658 - RNA, 18 nt, Artificial Sequence
  Synthetic
gaauauuuaaacacuucu

SEQ ID NO: 26659 - RNA, 19 nt, Artificial Sequence
  Synthetic
ggaauauuuaaacacuucu

SEQ ID NO: 26660 - RNA, 20 nt, Artificial Sequence
  Synthetic
gggaauauuuaaacacuucu

SEQ ID NO: 26661 - RNA, 21 nt, Artificial Sequence
  Synthetic
ugggaauauuuaaacacuucu

SEQ ID NO: 26662 - RNA, 22 nt, Artificial Sequence
  Synthetic
uugggaauauuuaaacacuucu

SEQ ID NO: 26663 - RNA, 23 nt, Artificial Sequence
  Synthetic
cuugggaauauuuaaacacuucu

SEQ ID NO: 26664 - RNA, 24 nt, Artificial Sequence
  Synthetic
ccuugggaauauuuaaacacuucu

SEQ ID NO: 26665 - RNA, 18 nt, Artificial Sequence
  Synthetic
acccaauaaaauaaaagu

SEQ ID NO: 26666 - RNA, 19 nt, Artificial Sequence
  Synthetic
aacccaauaaaauaaaagu

SEQ ID NO: 26667 - RNA, 20 nt, Artificial Sequence
  Synthetic
aaacccaauaaaauaaaagu

SEQ ID NO: 26668 - RNA, 21 nt, Artificial Sequence
  Synthetic
aaaacccaauaaaauaaaagu

SEQ ID NO: 26669 - RNA, 22 nt, Artificial Sequence
  Synthetic
gaaaacccaauaaaauaaaagu

SEQ ID NO: 26670 - RNA, 23 nt, Artificial Sequence
  Synthetic
agaaaacccaauaaaauaaaagu

SEQ ID NO: 26671 - RNA, 24 nt, Artificial Sequence
  Synthetic
aagaaaacccaauaaaauaaaagu

SEQ ID NO: 26672 - RNA, 18 nt, Artificial Sequence
  Synthetic
augaggaagaaaggaagu

SEQ ID NO: 26673 - RNA, 19 nt, Artificial Sequence
  Synthetic
aaugaggaagaaaggaagu

SEQ ID NO: 26674 - RNA, 21 nt, Artificial Sequence
  Synthetic
gaaaugaggaagaaaggaagu

SEQ ID NO: 26675 - RNA, 22 nt, Artificial Sequence
  Synthetic
ggaaaugaggaagaaaggaagu

SEQ ID NO: 26676 - RNA, 23 nt, Artificial Sequence
  Synthetic
aggaaaugaggaagaaaggaagu

SEQ ID NO: 26677 - RNA, 24 nt, Artificial Sequence
  Synthetic
aaggaaaugaggaagaaaggaagu

SEQ ID NO: 26678 - RNA, 18 nt, Artificial Sequence
  Synthetic
ggaaagaaggaaggaagu

SEQ ID NO: 26679 - RNA, 19 nt, Artificial Sequence
  Synthetic
aggaaagaaggaaggaagu

SEQ ID NO: 26680 - RNA, 20 nt, Artificial Sequence
  Synthetic
aaggaaagaaggaaggaagu

SEQ ID NO: 26681 - RNA, 21 nt, Artificial Sequence
  Synthetic
gaaggaaagaaggaaggaagu

SEQ ID NO: 26682 - RNA, 22 nt, Artificial Sequence
  Synthetic
ggaaggaaagaaggaaggaagu

SEQ ID NO: 26683 - RNA, 23 nt, Artificial Sequence
  Synthetic
aggaaggaaagaaggaaggaagu

SEQ ID NO: 26684 - RNA, 24 nt, Artificial Sequence
  Synthetic
aaggaaggaaagaaggaaggaagu

SEQ ID NO: 26685 - RNA, 18 nt, Artificial Sequence
  Synthetic
gguuugggaauauuaagu

SEQ ID NO: 26686 - RNA, 19 nt, Artificial Sequence
  Synthetic
ugguuugggaauauuaagu

SEQ ID NO: 26687 - RNA, 20 nt, Artificial Sequence
  Synthetic
uugguuugggaauauuaagu

SEQ ID NO: 26688 - RNA, 21 nt, Artificial Sequence
  Synthetic
cuugguuugggaauauuaagu

SEQ ID NO: 26689 - RNA, 22 nt, Artificial Sequence
  Synthetic
gcuugguuugggaauauuaagu

SEQ ID NO: 26690 - RNA, 23 nt, Artificial Sequence
  Synthetic
agcuugguuugggaauauuaagu

SEQ ID NO: 26691 - RNA, 24 nt, Artificial Sequence
  Synthetic
gagcuugguuugggaauauuaagu

SEQ ID NO: 26692 - RNA, 18 nt, Artificial Sequence
  Synthetic
ucugguuugaagaacagu

SEQ ID NO: 26693 - RNA, 19 nt, Artificial Sequence
  Synthetic
gucugguuugaagaacagu

SEQ ID NO: 26694 - RNA, 20 nt, Artificial Sequence
  Synthetic
ugucugguuugaagaacagu

SEQ ID NO: 26695 - RNA, 21 nt, Artificial Sequence
  Synthetic
cugucugguuugaagaacagu

SEQ ID NO: 26696 - RNA, 22 nt, Artificial Sequence
  Synthetic
ccugucugguuugaagaacagu

SEQ ID NO: 26697 - RNA, 23 nt, Artificial Sequence
  Synthetic
accugucugguuugaagaacagu

SEQ ID NO: 26698 - RNA, 24 nt, Artificial Sequence
  Synthetic
uaccugucugguuugaagaacagu

SEQ ID NO: 26699 - RNA, 18 nt, Artificial Sequence
  Synthetic
cagcuaugaaggcagagu

SEQ ID NO: 26700 - RNA, 19 nt, Artificial Sequence
  Synthetic
gcagcuaugaaggcagagu

SEQ ID NO: 26701 - RNA, 20 nt, Artificial Sequence
  Synthetic
agcagcuaugaaggcagagu

SEQ ID NO: 26702 - RNA, 21 nt, Artificial Sequence
  Synthetic
aagcagcuaugaaggcagagu

SEQ ID NO: 26703 - RNA, 22 nt, Artificial Sequence
  Synthetic
aaagcagcuaugaaggcagagu

SEQ ID NO: 26704 - RNA, 23 nt, Artificial Sequence
  Synthetic
aaaagcagcuaugaaggcagagu

SEQ ID NO: 26705 - RNA, 24 nt, Artificial Sequence
  Synthetic
gaaaagcagcuaugaaggcagagu

SEQ ID NO: 26706 - RNA, 18 nt, Artificial Sequence
  Synthetic
uugcuugaguccaggagu

SEQ ID NO: 26707 - RNA, 19 nt, Artificial Sequence
  Synthetic
auugcuugaguccaggagu

SEQ ID NO: 26708 - RNA, 20 nt, Artificial Sequence
  Synthetic
aauugcuugaguccaggagu

SEQ ID NO: 26709 - RNA, 21 nt, Artificial Sequence
  Synthetic
gaauugcuugaguccaggagu

SEQ ID NO: 26710 - RNA, 22 nt, Artificial Sequence
  Synthetic
ugaauugcuugaguccaggagu

SEQ ID NO: 26711 - RNA, 23 nt, Artificial Sequence
  Synthetic
gugaauugcuugaguccaggagu

SEQ ID NO: 26712 - RNA, 24 nt, Artificial Sequence
  Synthetic
ggugaauugcuugaguccaggagu

SEQ ID NO: 26713 - RNA, 18 nt, Artificial Sequence
  Synthetic
ggaagcaaggagaugagu

SEQ ID NO: 26714 - RNA, 19 nt, Artificial Sequence
  Synthetic
aggaagcaaggagaugagu

SEQ ID NO: 26715 - RNA, 20 nt, Artificial Sequence
  Synthetic
gaggaagcaaggagaugagu

SEQ ID NO: 26716 - RNA, 21 nt, Artificial Sequence
  Synthetic
ggaggaagcaaggagaugagu

SEQ ID NO: 26717 - RNA, 22 nt, Artificial Sequence
  Synthetic
gggaggaagcaaggagaugagu

SEQ ID NO: 26718 - RNA, 23 nt, Artificial Sequence
  Synthetic
agggaggaagcaaggagaugagu

SEQ ID NO: 26719 - RNA, 24 nt, Artificial Sequence
  Synthetic
aagggaggaagcaaggagaugagu

SEQ ID NO: 26720 - RNA, 18 nt, Artificial Sequence
  Synthetic
uaguggaaguaguauagu

SEQ ID NO: 26721 - RNA, 19 nt, Artificial Sequence
  Synthetic
guaguggaaguaguauagu

SEQ ID NO: 26722 - RNA, 21 nt, Artificial Sequence
  Synthetic
uaguaguggaaguaguauagu

SEQ ID NO: 26723 - RNA, 22 nt, Artificial Sequence
  Synthetic
guaguaguggaaguaguauagu

SEQ ID NO: 26724 - RNA, 23 nt, Artificial Sequence
  Synthetic
gguaguaguggaaguaguauagu

SEQ ID NO: 26725 - RNA, 24 nt, Artificial Sequence
  Synthetic
agguaguaguggaaguaguauagu

SEQ ID NO: 26726 - RNA, 18 nt, Artificial Sequence
  Synthetic
gaagagggggcugguagu

SEQ ID NO: 26727 - RNA, 19 nt, Artificial Sequence
  Synthetic
ggaagagggggcugguagu

SEQ ID NO: 26728 - RNA, 20 nt, Artificial Sequence
  Synthetic
aggaagagggggcugguagu

SEQ ID NO: 26729 - RNA, 21 nt, Artificial Sequence
  Synthetic
aaggaagagggggcugguagu

SEQ ID NO: 26730 - RNA, 22 nt, Artificial Sequence
  Synthetic
caaggaagagggggcugguagu

SEQ ID NO: 26731 - RNA, 23 nt, Artificial Sequence
  Synthetic
ucaaggaagagggggcugguagu

SEQ ID NO: 26732 - RNA, 24 nt, Artificial Sequence
  Synthetic
uucaaggaagagggggcugguagu

SEQ ID NO: 26733 - RNA, 18 nt, Artificial Sequence
  Synthetic
gaugcuaaucaucuccgu

SEQ ID NO: 26734 - RNA, 19 nt, Artificial Sequence
  Synthetic
ugaugcuaaucaucuccgu

SEQ ID NO: 26735 - RNA, 20 nt, Artificial Sequence
  Synthetic
gugaugcuaaucaucuccgu

SEQ ID NO: 26736 - RNA, 21 nt, Artificial Sequence
  Synthetic
cgugaugcuaaucaucuccgu

SEQ ID NO: 26737 - RNA, 22 nt, Artificial Sequence
  Synthetic
acgugaugcuaaucaucuccgu

SEQ ID NO: 26738 - RNA, 23 nt, Artificial Sequence
  Synthetic
cacgugaugcuaaucaucuccgu

SEQ ID NO: 26739 - RNA, 24 nt, Artificial Sequence
  Synthetic
ccacgugaugcuaaucaucuccgu

SEQ ID NO: 26740 - RNA, 18 nt, Artificial Sequence
  Synthetic
gcagcuaugccagcaggu

SEQ ID NO: 26741 - RNA, 19 nt, Artificial Sequence
  Synthetic
ugcagcuaugccagcaggu

SEQ ID NO: 26742 - RNA, 20 nt, Artificial Sequence
  Synthetic
gugcagcuaugccagcaggu

SEQ ID NO: 26743 - RNA, 21 nt, Artificial Sequence
  Synthetic
agugcagcuaugccagcaggu

SEQ ID NO: 26744 - RNA, 22 nt, Artificial Sequence
  Synthetic
cagugcagcuaugccagcaggu

SEQ ID NO: 26745 - RNA, 23 nt, Artificial Sequence
  Synthetic
ucagugcagcuaugccagcaggu

SEQ ID NO: 26746 - RNA, 24 nt, Artificial Sequence
  Synthetic
aucagugcagcuaugccagcaggu

SEQ ID NO: 26747 - RNA, 18 nt, Artificial Sequence
  Synthetic
ucagugcuuuuucgaggu

SEQ ID NO: 26748 - RNA, 19 nt, Artificial Sequence
  Synthetic
aucagugcuuuuucgaggu

SEQ ID NO: 26749 - RNA, 20 nt, Artificial Sequence
  Synthetic
aaucagugcuuuuucgaggu

SEQ ID NO: 26750 - RNA, 21 nt, Artificial Sequence
  Synthetic
aaaucagugcuuuuucgaggu

SEQ ID NO: 26751 - RNA, 22 nt, Artificial Sequence
  Synthetic
aaaaucagugcuuuuucgaggu

SEQ ID NO: 26752 - RNA, 23 nt, Artificial Sequence
  Synthetic
uaaaaucagugcuuuuucgaggu

SEQ ID NO: 26753 - RNA, 24 nt, Artificial Sequence
  Synthetic
auaaaaucagugcuuuuucgaggu

SEQ ID NO: 26754 - RNA, 18 nt, Artificial Sequence
  Synthetic
caaagacuugcaggaggu

SEQ ID NO: 26755 - RNA, 19 nt, Artificial Sequence
  Synthetic
acaaagacuugcaggaggu

SEQ ID NO: 26756 - RNA, 20 nt, Artificial Sequence
  Synthetic
aacaaagacuugcaggaggu

SEQ ID NO: 26757 - RNA, 21 nt, Artificial Sequence
  Synthetic
gaacaaagacuugcaggaggu

SEQ ID NO: 26758 - RNA, 22 nt, Artificial Sequence
  Synthetic
ugaacaaagacuugcaggaggu

SEQ ID NO: 26759 - RNA, 23 nt, Artificial Sequence
  Synthetic
uugaacaaagacuugcaggaggu

SEQ ID NO: 26760 - RNA, 24 nt, Artificial Sequence
  Synthetic
uuugaacaaagacuugcaggaggu

SEQ ID NO: 26761 - RNA, 18 nt, Artificial Sequence
  Synthetic
guaaucggcgguggaggu

SEQ ID NO: 26762 - RNA, 19 nt, Artificial Sequence
  Synthetic
aguaaucggcgguggaggu

SEQ ID NO: 26763 - RNA, 21 nt, Artificial Sequence
  Synthetic
gaaguaaucggcgguggaggu

SEQ ID NO: 26764 - RNA, 22 nt, Artificial Sequence
  Synthetic
agaaguaaucggcgguggaggu

SEQ ID NO: 26765 - RNA, 23 nt, Artificial Sequence
  Synthetic
gagaaguaaucggcgguggaggu

SEQ ID NO: 26766 - RNA, 24 nt, Artificial Sequence
  Synthetic
agagaaguaaucggcgguggaggu

SEQ ID NO: 26767 - RNA, 18 nt, Artificial Sequence
  Synthetic
uacuugggaggcugaggu

SEQ ID NO: 26768 - RNA, 19 nt, Artificial Sequence
  Synthetic
cuacuugggaggcugaggu

SEQ ID NO: 26769 - RNA, 21 nt, Artificial Sequence
  Synthetic
agcuacuugggaggcugaggu

SEQ ID NO: 26770 - RNA, 22 nt, Artificial Sequence
  Synthetic
cagcuacuugggaggcugaggu

SEQ ID NO: 26771 - RNA, 23 nt, Artificial Sequence
  Synthetic
ccagcuacuugggaggcugaggu

SEQ ID NO: 26772 - RNA, 24 nt, Artificial Sequence
  Synthetic
cccagcuacuugggaggcugaggu

SEQ ID NO: 26773 - RNA, 18 nt, Artificial Sequence
  Synthetic
aggagccaaaaauugggu

SEQ ID NO: 26774 - RNA, 19 nt, Artificial Sequence
  Synthetic
caggagccaaaaauugggu

SEQ ID NO: 26775 - RNA, 21 nt, Artificial Sequence
  Synthetic
uucaggagccaaaaauugggu

SEQ ID NO: 26776 - RNA, 22 nt, Artificial Sequence
  Synthetic
uuucaggagccaaaaauugggu

SEQ ID NO: 26777 - RNA, 23 nt, Artificial Sequence
  Synthetic
cuuucaggagccaaaaauugggu

SEQ ID NO: 26778 - RNA, 24 nt, Artificial Sequence
  Synthetic
gcuuucaggagccaaaaauugggu

SEQ ID NO: 26779 - RNA, 18 nt, Artificial Sequence
  Synthetic
ugacuauaccugucuggu

SEQ ID NO: 26780 - RNA, 19 nt, Artificial Sequence
  Synthetic
cugacuauaccugucuggu

SEQ ID NO: 26781 - RNA, 20 nt, Artificial Sequence
  Synthetic
acugacuauaccugucuggu

SEQ ID NO: 26782 - RNA, 21 nt, Artificial Sequence
  Synthetic
gacugacuauaccugucuggu

SEQ ID NO: 26783 - RNA, 22 nt, Artificial Sequence
  Synthetic
ggacugacuauaccugucuggu

SEQ ID NO: 26784 - RNA, 23 nt, Artificial Sequence
  Synthetic
gggacugacuauaccugucuggu

SEQ ID NO: 26785 - RNA, 24 nt, Artificial Sequence
  Synthetic
ugggacugacuauaccugucuggu

SEQ ID NO: 26786 - RNA, 18 nt, Artificial Sequence
  Synthetic
uuuuggauggagcuuggu

SEQ ID NO: 26787 - RNA, 19 nt, Artificial Sequence
  Synthetic
guuuuggauggagcuuggu

SEQ ID NO: 26788 - RNA, 20 nt, Artificial Sequence
  Synthetic
gguuuuggauggagcuuggu

SEQ ID NO: 26789 - RNA, 21 nt, Artificial Sequence
  Synthetic
agguuuuggauggagcuuggu

SEQ ID NO: 26790 - RNA, 22 nt, Artificial Sequence
  Synthetic
cagguuuuggauggagcuuggu

SEQ ID NO: 26791 - RNA, 23 nt, Artificial Sequence
  Synthetic
acagguuuuggauggagcuuggu

SEQ ID NO: 26792 - RNA, 24 nt, Artificial Sequence
  Synthetic
aacagguuuuggauggagcuuggu

SEQ ID NO: 26793 - RNA, 18 nt, Artificial Sequence
  Synthetic
gguacuuuguagaaaugu

SEQ ID NO: 26794 - RNA, 19 nt, Artificial Sequence
  Synthetic
ugguacuuuguagaaaugu

SEQ ID NO: 26795 - RNA, 20 nt, Artificial Sequence
  Synthetic
gugguacuuuguagaaaugu

SEQ ID NO: 26796 - RNA, 21 nt, Artificial Sequence
  Synthetic
ugugguacuuuguagaaaugu

SEQ ID NO: 26797 - RNA, 22 nt, Artificial Sequence
  Synthetic
cugugguacuuuguagaaaugu

SEQ ID NO: 26798 - RNA, 23 nt, Artificial Sequence
  Synthetic
gcugugguacuuuguagaaaugu

SEQ ID NO: 26799 - RNA, 24 nt, Artificial Sequence
  Synthetic
agcugugguacuuuguagaaaugu

SEQ ID NO: 26800 - RNA, 18 nt, Artificial Sequence
  Synthetic
caccccuuucugccaugu

SEQ ID NO: 26801 - RNA, 19 nt, Artificial Sequence
  Synthetic
ucaccccuuucugccaugu

SEQ ID NO: 26802 - RNA, 20 nt, Artificial Sequence
  Synthetic
cucaccccuuucugccaugu

SEQ ID NO: 26803 - RNA, 21 nt, Artificial Sequence
  Synthetic
ccucaccccuuucugccaugu

SEQ ID NO: 26804 - RNA, 22 nt, Artificial Sequence
  Synthetic
cccucaccccuuucugccaugu

SEQ ID NO: 26805 - RNA, 23 nt, Artificial Sequence
  Synthetic
acccucaccccuuucugccaugu

SEQ ID NO: 26806 - RNA, 24 nt, Artificial Sequence
  Synthetic
gacccucaccccuuucugccaugu

SEQ ID NO: 26807 - RNA, 18 nt, Artificial Sequence
  Synthetic
cccagccuccagaacugu

SEQ ID NO: 26808 - RNA, 19 nt, Artificial Sequence
  Synthetic
ucccagccuccagaacugu

SEQ ID NO: 26809 - RNA, 20 nt, Artificial Sequence
  Synthetic
uucccagccuccagaacugu

SEQ ID NO: 26810 - RNA, 21 nt, Artificial Sequence
  Synthetic
cuucccagccuccagaacugu

SEQ ID NO: 26811 - RNA, 22 nt, Artificial Sequence
  Synthetic
acuucccagccuccagaacugu

SEQ ID NO: 26812 - RNA, 23 nt, Artificial Sequence
  Synthetic
gacuucccagccuccagaacugu

SEQ ID NO: 26813 - RNA, 24 nt, Artificial Sequence
  Synthetic
ggacuucccagccuccagaacugu

SEQ ID NO: 26814 - RNA, 18 nt, Artificial Sequence
  Synthetic
gggaggguagaauacugu

SEQ ID NO: 26815 - RNA, 19 nt, Artificial Sequence
  Synthetic
agggaggguagaauacugu

SEQ ID NO: 26816 - RNA, 20 nt, Artificial Sequence
  Synthetic
cagggaggguagaauacugu

SEQ ID NO: 26817 - RNA, 21 nt, Artificial Sequence
  Synthetic
acagggaggguagaauacugu

SEQ ID NO: 26818 - RNA, 22 nt, Artificial Sequence
  Synthetic
gacagggaggguagaauacugu

SEQ ID NO: 26819 - RNA, 23 nt, Artificial Sequence
  Synthetic
agacagggaggguagaauacugu

SEQ ID NO: 26820 - RNA, 24 nt, Artificial Sequence
  Synthetic
aagacagggaggguagaauacugu

SEQ ID NO: 26821 - RNA, 18 nt, Artificial Sequence
  Synthetic
guuuuuaggcuauucugu

SEQ ID NO: 26822 - RNA, 19 nt, Artificial Sequence
  Synthetic
uguuuuuaggcuauucugu

SEQ ID NO: 26823 - RNA, 21 nt, Artificial Sequence
  Synthetic
aauguuuuuaggcuauucugu

SEQ ID NO: 26824 - RNA, 22 nt, Artificial Sequence
  Synthetic
uaauguuuuuaggcuauucugu

SEQ ID NO: 26825 - RNA, 23 nt, Artificial Sequence
  Synthetic
cuaauguuuuuaggcuauucugu

SEQ ID NO: 26826 - RNA, 24 nt, Artificial Sequence
  Synthetic
gcuaauguuuuuaggcuauucugu

SEQ ID NO: 26827 - RNA, 18 nt, Artificial Sequence
  Synthetic
auggcaucucaccagugu

SEQ ID NO: 26828 - RNA, 19 nt, Artificial Sequence
  Synthetic
uauggcaucucaccagugu

SEQ ID NO: 26829 - RNA, 20 nt, Artificial Sequence
  Synthetic
uuauggcaucucaccagugu

SEQ ID NO: 26830 - RNA, 21 nt, Artificial Sequence
  Synthetic
cuuauggcaucucaccagugu

SEQ ID NO: 26831 - RNA, 22 nt, Artificial Sequence
  Synthetic
gcuuauggcaucucaccagugu

SEQ ID NO: 26832 - RNA, 23 nt, Artificial Sequence
  Synthetic
ggcuuauggcaucucaccagugu

SEQ ID NO: 26833 - RNA, 24 nt, Artificial Sequence
  Synthetic
uggcuuauggcaucucaccagugu

SEQ ID NO: 26834 - RNA, 18 nt, Artificial Sequence
  Synthetic
ggcaucucaccagugugu

SEQ ID NO: 26835 - RNA, 19 nt, Artificial Sequence
  Synthetic
uggcaucucaccagugugu

SEQ ID NO: 26836 - RNA, 21 nt, Artificial Sequence
  Synthetic
uauggcaucucaccagugugu

SEQ ID NO: 26837 - RNA, 22 nt, Artificial Sequence
  Synthetic
uuauggcaucucaccagugugu

SEQ ID NO: 26838 - RNA, 23 nt, Artificial Sequence
  Synthetic
cuuauggcaucucaccagugugu

SEQ ID NO: 26839 - RNA, 24 nt, Artificial Sequence
  Synthetic
gcuuauggcaucucaccagugugu

SEQ ID NO: 26840 - RNA, 18 nt, Artificial Sequence
  Synthetic
guauguauauaugugugu

SEQ ID NO: 26841 - RNA, 19 nt, Artificial Sequence
  Synthetic
uguauguauauaugugugu

SEQ ID NO: 26842 - RNA, 20 nt, Artificial Sequence
  Synthetic
auguauguauauaugugugu

SEQ ID NO: 26843 - RNA, 21 nt, Artificial Sequence
  Synthetic
uauguauguauauaugugugu

SEQ ID NO: 26844 - RNA, 22 nt, Artificial Sequence
  Synthetic
auauguauguauauaugugugu

SEQ ID NO: 26845 - RNA, 23 nt, Artificial Sequence
  Synthetic
cauauguauguauauaugugugu

SEQ ID NO: 26846 - RNA, 24 nt, Artificial Sequence
  Synthetic
ucauauguauguauauaugugugu

SEQ ID NO: 26847 - RNA, 18 nt, Artificial Sequence
  Synthetic
ucuaacuuuucuuauugu

SEQ ID NO: 26848 - RNA, 19 nt, Artificial Sequence
  Synthetic
uucuaacuuuucuuauugu

SEQ ID NO: 26849 - RNA, 20 nt, Artificial Sequence
  Synthetic
cuucuaacuuuucuuauugu

SEQ ID NO: 26850 - RNA, 21 nt, Artificial Sequence
  Synthetic
acuucuaacuuuucuuauugu

SEQ ID NO: 26851 - RNA, 22 nt, Artificial Sequence
  Synthetic
uacuucuaacuuuucuuauugu

SEQ ID NO: 26852 - RNA, 23 nt, Artificial Sequence
  Synthetic
uuacuucuaacuuuucuuauugu

SEQ ID NO: 26853 - RNA, 24 nt, Artificial Sequence
  Synthetic
uuuacuucuaacuuuucuuauugu

SEQ ID NO: 26854 - RNA, 18 nt, Artificial Sequence
  Synthetic
ggaccaaaacuuuauugu

SEQ ID NO: 26855 - RNA, 19 nt, Artificial Sequence
  Synthetic
aggaccaaaacuuuauugu

SEQ ID NO: 26856 - RNA, 20 nt, Artificial Sequence
  Synthetic
aaggaccaaaacuuuauugu

SEQ ID NO: 26857 - RNA, 21 nt, Artificial Sequence
  Synthetic
aaaggaccaaaacuuuauugu

SEQ ID NO: 26858 - RNA, 22 nt, Artificial Sequence
  Synthetic
aaaaggaccaaaacuuuauugu

SEQ ID NO: 26859 - RNA, 23 nt, Artificial Sequence
  Synthetic
caaaaggaccaaaacuuuauugu

SEQ ID NO: 26860 - RNA, 24 nt, Artificial Sequence
  Synthetic
gcaaaaggaccaaaacuuuauugu

SEQ ID NO: 26861 - RNA, 18 nt, Artificial Sequence
  Synthetic
uacccaauaaaaaaaauu

SEQ ID NO: 26862 - RNA, 19 nt, Artificial Sequence
  Synthetic
uuacccaauaaaaaaaauu

SEQ ID NO: 26863 - RNA, 21 nt, Artificial Sequence
  Synthetic
uguuacccaauaaaaaaaauu

SEQ ID NO: 26864 - RNA, 22 nt, Artificial Sequence
  Synthetic
uuguuacccaauaaaaaaaauu

SEQ ID NO: 26865 - RNA, 23 nt, Artificial Sequence
  Synthetic
auuguuacccaauaaaaaaaauu

SEQ ID NO: 26866 - RNA, 24 nt, Artificial Sequence
  Synthetic
uauuguuacccaauaaaaaaaauu

SEQ ID NO: 26867 - RNA, 18 nt, Artificial Sequence
  Synthetic
agaaauaccgagaaaauu

SEQ ID NO: 26868 - RNA, 19 nt, Artificial Sequence
  Synthetic
uagaaauaccgagaaaauu

SEQ ID NO: 26869 - RNA, 20 nt, Artificial Sequence
  Synthetic
cuagaaauaccgagaaaauu

SEQ ID NO: 26870 - RNA, 21 nt, Artificial Sequence
  Synthetic
ccuagaaauaccgagaaaauu

SEQ ID NO: 26871 - RNA, 22 nt, Artificial Sequence
  Synthetic
gccuagaaauaccgagaaaauu

SEQ ID NO: 26872 - RNA, 23 nt, Artificial Sequence
  Synthetic
agccuagaaauaccgagaaaauu

SEQ ID NO: 26873 - RNA, 24 nt, Artificial Sequence
  Synthetic
uagccuagaaauaccgagaaaauu

SEQ ID NO: 26874 - RNA, 18 nt, Artificial Sequence
  Synthetic
uuaaugaaaauagaaauu

SEQ ID NO: 26875 - RNA, 19 nt, Artificial Sequence
  Synthetic
guuaaugaaaauagaaauu

SEQ ID NO: 26876 - RNA, 20 nt, Artificial Sequence
  Synthetic
uguuaaugaaaauagaaauu

SEQ ID NO: 26877 - RNA, 21 nt, Artificial Sequence
  Synthetic
auguuaaugaaaauagaaauu

SEQ ID NO: 26878 - RNA, 22 nt, Artificial Sequence
  Synthetic
aauguuaaugaaaauagaaauu

SEQ ID NO: 26879 - RNA, 23 nt, Artificial Sequence
  Synthetic
aaauguuaaugaaaauagaaauu

SEQ ID NO: 26880 - RNA, 24 nt, Artificial Sequence
  Synthetic
aaaauguuaaugaaaauagaaauu

SEQ ID NO: 26881 - RNA, 18 nt, Artificial Sequence
  Synthetic
cuacaguugccugcaauu

SEQ ID NO: 26882 - RNA, 19 nt, Artificial Sequence
  Synthetic
gcuacaguugccugcaauu

SEQ ID NO: 26883 - RNA, 20 nt, Artificial Sequence
  Synthetic
agcuacaguugccugcaauu

SEQ ID NO: 26884 - RNA, 21 nt, Artificial Sequence
  Synthetic
cagcuacaguugccugcaauu

SEQ ID NO: 26885 - RNA, 22 nt, Artificial Sequence
  Synthetic
gcagcuacaguugccugcaauu

SEQ ID NO: 26886 - RNA, 23 nt, Artificial Sequence
  Synthetic
ugcagcuacaguugccugcaauu

SEQ ID NO: 26887 - RNA, 24 nt, Artificial Sequence
  Synthetic
cugcagcuacaguugccugcaauu

SEQ ID NO: 26888 - RNA, 18 nt, Artificial Sequence
  Synthetic
uaucaauauuuuggaauu

SEQ ID NO: 26889 - RNA, 19 nt, Artificial Sequence
  Synthetic
uuaucaauauuuuggaauu

SEQ ID NO: 26890 - RNA, 20 nt, Artificial Sequence
  Synthetic
uuuaucaauauuuuggaauu

SEQ ID NO: 26891 - RNA, 21 nt, Artificial Sequence
  Synthetic
uuuuaucaauauuuuggaauu

SEQ ID NO: 26892 - RNA, 22 nt, Artificial Sequence
  Synthetic
guuuuaucaauauuuuggaauu

SEQ ID NO: 26893 - RNA, 23 nt, Artificial Sequence
  Synthetic
aguuuuaucaauauuuuggaauu

SEQ ID NO: 26894 - RNA, 24 nt, Artificial Sequence
  Synthetic
uaguuuuaucaauauuuuggaauu

SEQ ID NO: 26895 - RNA, 18 nt, Artificial Sequence
  Synthetic
gguacuacuguaauaauu

SEQ ID NO: 26896 - RNA, 19 nt, Artificial Sequence
  Synthetic
ugguacuacuguaauaauu

SEQ ID NO: 26897 - RNA, 21 nt, Artificial Sequence
  Synthetic
uaugguacuacuguaauaauu

SEQ ID NO: 26898 - RNA, 22 nt, Artificial Sequence
  Synthetic
auaugguacuacuguaauaauu

SEQ ID NO: 26899 - RNA, 23 nt, Artificial Sequence
  Synthetic
cauaugguacuacuguaauaauu

SEQ ID NO: 26900 - RNA, 24 nt, Artificial Sequence
  Synthetic
acauaugguacuacuguaauaauu

SEQ ID NO: 26901 - RNA, 18 nt, Artificial Sequence
  Synthetic
aaauaucaccaacucauu

SEQ ID NO: 26902 - RNA, 19 nt, Artificial Sequence
  Synthetic
aaaauaucaccaacucauu

SEQ ID NO: 26903 - RNA, 21 nt, Artificial Sequence
  Synthetic
gaaaaauaucaccaacucauu

SEQ ID NO: 26904 - RNA, 22 nt, Artificial Sequence
  Synthetic
ugaaaaauaucaccaacucauu

SEQ ID NO: 26905 - RNA, 23 nt, Artificial Sequence
  Synthetic
augaaaaauaucaccaacucauu

SEQ ID NO: 26906 - RNA, 24 nt, Artificial Sequence
  Synthetic
aaugaaaaauaucaccaacucauu

SEQ ID NO: 26907 - RNA, 18 nt, Artificial Sequence
  Synthetic
guaggaagugaucagauu

SEQ ID NO: 26908 - RNA, 19 nt, Artificial Sequence
  Synthetic
aguaggaagugaucagauu

SEQ ID NO: 26909 - RNA, 20 nt, Artificial Sequence
  Synthetic
uaguaggaagugaucagauu

SEQ ID NO: 26910 - RNA, 21 nt, Artificial Sequence
  Synthetic
auaguaggaagugaucagauu

SEQ ID NO: 26911 - RNA, 22 nt, Artificial Sequence
  Synthetic
uauaguaggaagugaucagauu

SEQ ID NO: 26912 - RNA, 23 nt, Artificial Sequence
  Synthetic
guauaguaggaagugaucagauu

SEQ ID NO: 26913 - RNA, 24 nt, Artificial Sequence
  Synthetic
aguauaguaggaagugaucagauu

SEQ ID NO: 26914 - RNA, 18 nt, Artificial Sequence
  Synthetic
agcuggcuauccaggauu

SEQ ID NO: 26915 - RNA, 19 nt, Artificial Sequence
  Synthetic
cagcuggcuauccaggauu

SEQ ID NO: 26916 - RNA, 20 nt, Artificial Sequence
  Synthetic
acagcuggcuauccaggauu

SEQ ID NO: 26917 - RNA, 21 nt, Artificial Sequence
  Synthetic
gacagcuggcuauccaggauu

SEQ ID NO: 26918 - RNA, 22 nt, Artificial Sequence
  Synthetic
agacagcuggcuauccaggauu

SEQ ID NO: 26919 - RNA, 23 nt, Artificial Sequence
  Synthetic
aagacagcuggcuauccaggauu

SEQ ID NO: 26920 - RNA, 24 nt, Artificial Sequence
  Synthetic
gaagacagcuggcuauccaggauu

SEQ ID NO: 26921 - RNA, 18 nt, Artificial Sequence
  Synthetic
ugcaggaggugagggauu

SEQ ID NO: 26922 - RNA, 19 nt, Artificial Sequence
  Synthetic
uugcaggaggugagggauu

SEQ ID NO: 26923 - RNA, 21 nt, Artificial Sequence
  Synthetic
acuugcaggaggugagggauu

SEQ ID NO: 26924 - RNA, 22 nt, Artificial Sequence
  Synthetic
gacuugcaggaggugagggauu

SEQ ID NO: 26925 - RNA, 23 nt, Artificial Sequence
  Synthetic
agacuugcaggaggugagggauu

SEQ ID NO: 26926 - RNA, 24 nt, Artificial Sequence
  Synthetic
aagacuugcaggaggugagggauu

SEQ ID NO: 26927 - RNA, 18 nt, Artificial Sequence
  Synthetic
aauaguuuuaucaauauu

SEQ ID NO: 26928 - RNA, 19 nt, Artificial Sequence
  Synthetic
aaauaguuuuaucaauauu

SEQ ID NO: 26929 - RNA, 20 nt, Artificial Sequence
  Synthetic
caaauaguuuuaucaauauu

SEQ ID NO: 26930 - RNA, 21 nt, Artificial Sequence
  Synthetic
gcaaauaguuuuaucaauauu

SEQ ID NO: 26931 - RNA, 22 nt, Artificial Sequence
  Synthetic
ugcaaauaguuuuaucaauauu

SEQ ID NO: 26932 - RNA, 23 nt, Artificial Sequence
  Synthetic
cugcaaauaguuuuaucaauauu

SEQ ID NO: 26933 - RNA, 24 nt, Artificial Sequence
  Synthetic
ucugcaaauaguuuuaucaauauu

SEQ ID NO: 26934 - RNA, 18 nt, Artificial Sequence
  Synthetic
gaugaggagaaccauauu

SEQ ID NO: 26935 - RNA, 19 nt, Artificial Sequence
  Synthetic
agaugaggagaaccauauu

SEQ ID NO: 26936 - RNA, 20 nt, Artificial Sequence
  Synthetic
aagaugaggagaaccauauu

SEQ ID NO: 26937 - RNA, 21 nt, Artificial Sequence
  Synthetic
uaagaugaggagaaccauauu

SEQ ID NO: 26938 - RNA, 22 nt, Artificial Sequence
  Synthetic
cuaagaugaggagaaccauauu

SEQ ID NO: 26939 - RNA, 23 nt, Artificial Sequence
  Synthetic
ucuaagaugaggagaaccauauu

SEQ ID NO: 26940 - RNA, 24 nt, Artificial Sequence
  Synthetic
aucuaagaugaggagaaccauauu

SEQ ID NO: 26941 - RNA, 18 nt, Artificial Sequence
  Synthetic
aacuuaaccuggcauauu

SEQ ID NO: 26942 - RNA, 19 nt, Artificial Sequence
  Synthetic
caacuuaaccuggcauauu

SEQ ID NO: 26943 - RNA, 21 nt, Artificial Sequence
  Synthetic
aacaacuuaaccuggcauauu

SEQ ID NO: 26944 - RNA, 22 nt, Artificial Sequence
  Synthetic
gaacaacuuaaccuggcauauu

SEQ ID NO: 26945 - RNA, 23 nt, Artificial Sequence
  Synthetic
agaacaacuuaaccuggcauauu

SEQ ID NO: 26946 - RNA, 24 nt, Artificial Sequence
  Synthetic
aagaacaacuuaaccuggcauauu

SEQ ID NO: 26947 - RNA, 18 nt, Artificial Sequence
  Synthetic
ugcucucuuuuaacuauu

SEQ ID NO: 26948 - RNA, 19 nt, Artificial Sequence
  Synthetic
uugcucucuuuuaacuauu

SEQ ID NO: 26949 - RNA, 20 nt, Artificial Sequence
  Synthetic
cuugcucucuuuuaacuauu

SEQ ID NO: 26950 - RNA, 21 nt, Artificial Sequence
  Synthetic
acuugcucucuuuuaacuauu

SEQ ID NO: 26951 - RNA, 22 nt, Artificial Sequence
  Synthetic
aacuugcucucuuuuaacuauu

SEQ ID NO: 26952 - RNA, 23 nt, Artificial Sequence
  Synthetic
aaacuugcucucuuuuaacuauu

SEQ ID NO: 26953 - RNA, 24 nt, Artificial Sequence
  Synthetic
aaaacuugcucucuuuuaacuauu

SEQ ID NO: 26954 - RNA, 18 nt, Artificial Sequence
  Synthetic
guuuuucuuuccuuuauu

SEQ ID NO: 26955 - RNA, 19 nt, Artificial Sequence
  Synthetic
uguuuuucuuuccuuuauu

SEQ ID NO: 26956 - RNA, 20 nt, Artificial Sequence
  Synthetic
auguuuuucuuuccuuuauu

SEQ ID NO: 26957 - RNA, 21 nt, Artificial Sequence
  Synthetic
uauguuuuucuuuccuuuauu

SEQ ID NO: 26958 - RNA, 22 nt, Artificial Sequence
  Synthetic
uuauguuuuucuuuccuuuauu

SEQ ID NO: 26959 - RNA, 23 nt, Artificial Sequence
  Synthetic
uuuauguuuuucuuuccuuuauu

SEQ ID NO: 26960 - RNA, 24 nt, Artificial Sequence
  Synthetic
uuuuauguuuuucuuuccuuuauu

SEQ ID NO: 26961 - RNA, 18 nt, Artificial Sequence
  Synthetic
gggaauauuuaaacacuu

SEQ ID NO: 26962 - RNA, 19 nt, Artificial Sequence
  Synthetic
ugggaauauuuaaacacuu

SEQ ID NO: 26963 - RNA, 20 nt, Artificial Sequence
  Synthetic
uugggaauauuuaaacacuu

SEQ ID NO: 26964 - RNA, 21 nt, Artificial Sequence
  Synthetic
cuugggaauauuuaaacacuu

SEQ ID NO: 26965 - RNA, 22 nt, Artificial Sequence
  Synthetic
ccuugggaauauuuaaacacuu

SEQ ID NO: 26966 - RNA, 23 nt, Artificial Sequence
  Synthetic
cccuugggaauauuuaaacacuu

SEQ ID NO: 26967 - RNA, 24 nt, Artificial Sequence
  Synthetic
ucccuugggaauauuuaaacacuu

SEQ ID NO: 26968 - RNA, 18 nt, Artificial Sequence
  Synthetic
cuuguaauccuagcacuu

SEQ ID NO: 26969 - RNA, 19 nt, Artificial Sequence
  Synthetic
acuuguaauccuagcacuu

SEQ ID NO: 26970 - RNA, 20 nt, Artificial Sequence
  Synthetic
cacuuguaauccuagcacuu

SEQ ID NO: 26971 - RNA, 21 nt, Artificial Sequence
  Synthetic
acacuuguaauccuagcacuu

SEQ ID NO: 26972 - RNA, 22 nt, Artificial Sequence
  Synthetic
cacacuuguaauccuagcacuu

SEQ ID NO: 26973 - RNA, 23 nt, Artificial Sequence
  Synthetic
ucacacuuguaauccuagcacuu

SEQ ID NO: 26974 - RNA, 24 nt, Artificial Sequence
  Synthetic
cucacacuuguaauccuagcacuu

SEQ ID NO: 26975 - RNA, 18 nt, Artificial Sequence
  Synthetic
gaauugaauaugagacuu

SEQ ID NO: 26976 - RNA, 19 nt, Artificial Sequence
  Synthetic
agaauugaauaugagacuu

SEQ ID NO: 26977 - RNA, 21 nt, Artificial Sequence
  Synthetic
gaagaauugaauaugagacuu

SEQ ID NO: 26978 - RNA, 22 nt, Artificial Sequence
  Synthetic
ugaagaauugaauaugagacuu

SEQ ID NO: 26979 - RNA, 23 nt, Artificial Sequence
  Synthetic
uugaagaauugaauaugagacuu

SEQ ID NO: 26980 - RNA, 24 nt, Artificial Sequence
  Synthetic
uuugaagaauugaauaugagacuu

SEQ ID NO: 26981 - RNA, 23 nt, Artificial Sequence
  Synthetic
ugugccuguagucccagcuacuu

SEQ ID NO: 26982 - RNA, 24 nt, Artificial Sequence
  Synthetic
gugugccuguagucccagcuacuu

SEQ ID NO: 26983 - RNA, 18 nt, Artificial Sequence
  Synthetic
auugcaggguggggccuu

SEQ ID NO: 26984 - RNA, 19 nt, Artificial Sequence
  Synthetic
uauugcaggguggggccuu

SEQ ID NO: 26985 - RNA, 21 nt, Artificial Sequence
  Synthetic
gguauugcaggguggggccuu

SEQ ID NO: 26986 - RNA, 22 nt, Artificial Sequence
  Synthetic
ugguauugcaggguggggccuu

SEQ ID NO: 26987 - RNA, 23 nt, Artificial Sequence
  Synthetic
augguauugcaggguggggccuu

SEQ ID NO: 26988 - RNA, 24 nt, Artificial Sequence
  Synthetic
gaugguauugcaggguggggccuu

SEQ ID NO: 26989 - RNA, 18 nt, Artificial Sequence
  Synthetic
acagugcaguuauagcuu

SEQ ID NO: 26990 - RNA, 19 nt, Artificial Sequence
  Synthetic
gacagugcaguuauagcuu

SEQ ID NO: 26991 - RNA, 20 nt, Artificial Sequence
  Synthetic
ugacagugcaguuauagcuu

SEQ ID NO: 26992 - RNA, 21 nt, Artificial Sequence
  Synthetic
cugacagugcaguuauagcuu

SEQ ID NO: 26993 - RNA, 22 nt, Artificial Sequence
  Synthetic
gcugacagugcaguuauagcuu

SEQ ID NO: 26994 - RNA, 23 nt, Artificial Sequence
  Synthetic
ggcugacagugcaguuauagcuu

SEQ ID NO: 26995 - RNA, 24 nt, Artificial Sequence
  Synthetic
uggcugacagugcaguuauagcuu

SEQ ID NO: 26996 - RNA, 18 nt, Artificial Sequence
  Synthetic
auuaaaugucuugcgcuu

SEQ ID NO: 26997 - RNA, 19 nt, Artificial Sequence
  Synthetic
cauuaaaugucuugcgcuu

SEQ ID NO: 26998 - RNA, 20 nt, Artificial Sequence
  Synthetic
acauuaaaugucuugcgcuu

SEQ ID NO: 26999 - RNA, 21 nt, Artificial Sequence
  Synthetic
uacauuaaaugucuugcgcuu

SEQ ID NO: 27000 - RNA, 22 nt, Artificial Sequence
  Synthetic
cuacauuaaaugucuugcgcuu

SEQ ID NO: 27001 - RNA, 23 nt, Artificial Sequence
  Synthetic
ucuacauuaaaugucuugcgcuu

SEQ ID NO: 27002 - RNA, 24 nt, Artificial Sequence
  Synthetic
gucuacauuaaaugucuugcgcuu

SEQ ID NO: 27003 - RNA, 18 nt, Artificial Sequence
  Synthetic
ggcaauagguauuugcuu

SEQ ID NO: 27004 - RNA, 19 nt, Artificial Sequence
  Synthetic
gggcaauagguauuugcuu

SEQ ID NO: 27005 - RNA, 20 nt, Artificial Sequence
  Synthetic
agggcaauagguauuugcuu

SEQ ID NO: 27006 - RNA, 21 nt, Artificial Sequence
  Synthetic
aagggcaauagguauuugcuu

SEQ ID NO: 27007 - RNA, 22 nt, Artificial Sequence
  Synthetic
aaagggcaauagguauuugcuu

SEQ ID NO: 27008 - RNA, 23 nt, Artificial Sequence
  Synthetic
uaaagggcaauagguauuugcuu

SEQ ID NO: 27009 - RNA, 24 nt, Artificial Sequence
  Synthetic
cuaaagggcaauagguauuugcuu

SEQ ID NO: 27010 - RNA, 18 nt, Artificial Sequence
  Synthetic
aauuuaacugaauaucuu

SEQ ID NO: 27011 - RNA, 19 nt, Artificial Sequence
  Synthetic
aaauuuaacugaauaucuu

SEQ ID NO: 27012 - RNA, 20 nt, Artificial Sequence
  Synthetic
gaaauuuaacugaauaucuu

SEQ ID NO: 27013 - RNA, 21 nt, Artificial Sequence
  Synthetic
agaaauuuaacugaauaucuu

SEQ ID NO: 27014 - RNA, 22 nt, Artificial Sequence
  Synthetic
uagaaauuuaacugaauaucuu

SEQ ID NO: 27015 - RNA, 23 nt, Artificial Sequence
  Synthetic
auagaaauuuaacugaauaucuu

SEQ ID NO: 27016 - RNA, 24 nt, Artificial Sequence
  Synthetic
uauagaaauuuaacugaauaucuu

SEQ ID NO: 27017 - RNA, 18 nt, Artificial Sequence
  Synthetic
auaauuaaccggugucuu

SEQ ID NO: 27018 - RNA, 19 nt, Artificial Sequence
  Synthetic
uauaauuaaccggugucuu

SEQ ID NO: 27019 - RNA, 20 nt, Artificial Sequence
  Synthetic
uuauaauuaaccggugucuu

SEQ ID NO: 27020 - RNA, 21 nt, Artificial Sequence
  Synthetic
guuauaauuaaccggugucuu

SEQ ID NO: 27021 - RNA, 22 nt, Artificial Sequence
  Synthetic
uguuauaauuaaccggugucuu

SEQ ID NO: 27022 - RNA, 23 nt, Artificial Sequence
  Synthetic
cuguuauaauuaaccggugucuu

SEQ ID NO: 27023 - RNA, 24 nt, Artificial Sequence
  Synthetic
acuguuauaauuaaccggugucuu

SEQ ID NO: 27024 - RNA, 18 nt, Artificial Sequence
  Synthetic
uucuaaguauuagagguu

SEQ ID NO: 27025 - RNA, 19 nt, Artificial Sequence
  Synthetic
auucuaaguauuagagguu

SEQ ID NO: 27026 - RNA, 20 nt, Artificial Sequence
  Synthetic
cauucuaaguauuagagguu

SEQ ID NO: 27027 - RNA, 21 nt, Artificial Sequence
  Synthetic
gcauucuaaguauuagagguu

SEQ ID NO: 27028 - RNA, 22 nt, Artificial Sequence
  Synthetic
ggcauucuaaguauuagagguu

SEQ ID NO: 27029 - RNA, 23 nt, Artificial Sequence
  Synthetic
gggcauucuaaguauuagagguu

SEQ ID NO: 27030 - RNA, 24 nt, Artificial Sequence
  Synthetic
agggcauucuaaguauuagagguu

SEQ ID NO: 27031 - RNA, 18 nt, Artificial Sequence
  Synthetic
cagugcuuuuucgagguu

SEQ ID NO: 27032 - RNA, 19 nt, Artificial Sequence
  Synthetic
ucagugcuuuuucgagguu

SEQ ID NO: 27033 - RNA, 21 nt, Artificial Sequence
  Synthetic
aaucagugcuuuuucgagguu

SEQ ID NO: 27034 - RNA, 22 nt, Artificial Sequence
  Synthetic
aaaucagugcuuuuucgagguu

SEQ ID NO: 27035 - RNA, 23 nt, Artificial Sequence
  Synthetic
aaaaucagugcuuuuucgagguu

SEQ ID NO: 27036 - RNA, 24 nt, Artificial Sequence
  Synthetic
uaaaaucagugcuuuuucgagguu

SEQ ID NO: 27037 - RNA, 18 nt, Artificial Sequence
  Synthetic
uuuggauggagcuugguu

SEQ ID NO: 27038 - RNA, 19 nt, Artificial Sequence
  Synthetic
uuuuggauggagcuugguu

SEQ ID NO: 27039 - RNA, 21 nt, Artificial Sequence
  Synthetic
gguuuuggauggagcuugguu

SEQ ID NO: 27040 - RNA, 22 nt, Artificial Sequence
  Synthetic
agguuuuggauggagcuugguu

SEQ ID NO: 27041 - RNA, 23 nt, Artificial Sequence
  Synthetic
cagguuuuggauggagcuugguu

SEQ ID NO: 27042 - RNA, 24 nt, Artificial Sequence
  Synthetic
acagguuuuggauggagcuugguu

SEQ ID NO: 27043 - RNA, 18 nt, Artificial Sequence
  Synthetic
uaauacauuggaaaauuu

SEQ ID NO: 27044 - RNA, 19 nt, Artificial Sequence
  Synthetic
uuaauacauuggaaaauuu

SEQ ID NO: 27045 - RNA, 20 nt, Artificial Sequence
  Synthetic
guuaauacauuggaaaauuu

SEQ ID NO: 27046 - RNA, 21 nt, Artificial Sequence
  Synthetic
aguuaauacauuggaaaauuu

SEQ ID NO: 27047 - RNA, 22 nt, Artificial Sequence
  Synthetic
caguuaauacauuggaaaauuu

SEQ ID NO: 27048 - RNA, 23 nt, Artificial Sequence
  Synthetic
ucaguuaauacauuggaaaauuu

SEQ ID NO: 27049 - RNA, 24 nt, Artificial Sequence
  Synthetic
uucaguuaauacauuggaaaauuu

SEQ ID NO: 27050 - RNA, 18 nt, Artificial Sequence
  Synthetic
aucaauauuuuggaauuu

SEQ ID NO: 27051 - RNA, 19 nt, Artificial Sequence
  Synthetic
uaucaauauuuuggaauuu

SEQ ID NO: 27052 - RNA, 21 nt, Artificial Sequence
  Synthetic
uuuaucaauauuuuggaauuu

SEQ ID NO: 27053 - RNA, 22 nt, Artificial Sequence
  Synthetic
uuuuaucaauauuuuggaauuu

SEQ ID NO: 27054 - RNA, 23 nt, Artificial Sequence
  Synthetic
guuuuaucaauauuuuggaauuu

SEQ ID NO: 27055 - RNA, 24 nt, Artificial Sequence
  Synthetic
aguuuuaucaauauuuuggaauuu

SEQ ID NO: 27056 - RNA, 18 nt, Artificial Sequence
  Synthetic
uuaauauuacuauuauuu

SEQ ID NO: 27057 - RNA, 19 nt, Artificial Sequence
  Synthetic
auuaauauuacuauuauuu

SEQ ID NO: 27058 - RNA, 20 nt, Artificial Sequence
  Synthetic
uauuaauauuacuauuauuu

SEQ ID NO: 27059 - RNA, 21 nt, Artificial Sequence
  Synthetic
uuauuaauauuacuauuauuu

SEQ ID NO: 27060 - RNA, 22 nt, Artificial Sequence
  Synthetic
guuauuaauauuacuauuauuu

SEQ ID NO: 27061 - RNA, 23 nt, Artificial Sequence
  Synthetic
uguuauuaauauuacuauuauuu

SEQ ID NO: 27062 - RNA, 24 nt, Artificial Sequence
  Synthetic
uuguuauuaauauuacuauuauuu

SEQ ID NO: 27063 - RNA, 18 nt, Artificial Sequence
  Synthetic
aaacaaggauguuuauuu

SEQ ID NO: 27064 - RNA, 19 nt, Artificial Sequence
  Synthetic
uaaacaaggauguuuauuu

SEQ ID NO: 27065 - RNA, 20 nt, Artificial Sequence
  Synthetic
cuaaacaaggauguuuauuu

SEQ ID NO: 27066 - RNA, 21 nt, Artificial Sequence
  Synthetic
ucuaaacaaggauguuuauuu

SEQ ID NO: 27067 - RNA, 22 nt, Artificial Sequence
  Synthetic
gucuaaacaaggauguuuauuu

SEQ ID NO: 27068 - RNA, 23 nt, Artificial Sequence
  Synthetic
ggucuaaacaaggauguuuauuu

SEQ ID NO: 27069 - RNA, 24 nt, Artificial Sequence
  Synthetic
uggucuaaacaaggauguuuauuu

SEQ ID NO: 27070 - RNA, 18 nt, Artificial Sequence
  Synthetic
uuguaauccuagcacuuu

SEQ ID NO: 27071 - RNA, 19 nt, Artificial Sequence
  Synthetic
cuuguaauccuagcacuuu

SEQ ID NO: 27072 - RNA, 21 nt, Artificial Sequence
  Synthetic
cacuuguaauccuagcacuuu

SEQ ID NO: 27073 - RNA, 22 nt, Artificial Sequence
  Synthetic
acacuuguaauccuagcacuuu

SEQ ID NO: 27074 - RNA, 23 nt, Artificial Sequence
  Synthetic
cacacuuguaauccuagcacuuu

SEQ ID NO: 27075 - RNA, 24 nt, Artificial Sequence
  Synthetic
ucacacuuguaauccuagcacuuu

SEQ ID NO: 27076 - RNA, 18 nt, Artificial Sequence
  Synthetic
uugcaggguggggccuuu

SEQ ID NO: 27077 - RNA, 19 nt, Artificial Sequence
  Synthetic
auugcaggguggggccuuu

SEQ ID NO: 27078 - RNA, 21 nt, Artificial Sequence
  Synthetic
guauugcaggguggggccuuu

SEQ ID NO: 27079 - RNA, 22 nt, Artificial Sequence
  Synthetic
gguauugcaggguggggccuuu

SEQ ID NO: 27080 - RNA, 23 nt, Artificial Sequence
  Synthetic
ugguauugcaggguggggccuuu

SEQ ID NO: 27081 - RNA, 24 nt, Artificial Sequence
  Synthetic
augguauugcaggguggggccuuu

SEQ ID NO: 27082 - RNA, 18 nt, Artificial Sequence
  Synthetic
aagaugauuccaagcuuu

SEQ ID NO: 27083 - RNA, 19 nt, Artificial Sequence
  Synthetic
aaagaugauuccaagcuuu

SEQ ID NO: 27084 - RNA, 20 nt, Artificial Sequence
  Synthetic
caaagaugauuccaagcuuu

SEQ ID NO: 27085 - RNA, 21 nt, Artificial Sequence
  Synthetic
ucaaagaugauuccaagcuuu

SEQ ID NO: 27086 - RNA, 22 nt, Artificial Sequence
  Synthetic
gucaaagaugauuccaagcuuu

SEQ ID NO: 27087 - RNA, 23 nt, Artificial Sequence
  Synthetic
agucaaagaugauuccaagcuuu

SEQ ID NO: 27088 - RNA, 24 nt, Artificial Sequence
  Synthetic
gagucaaagaugauuccaagcuuu

SEQ ID NO: 27089 - RNA, 18 nt, Artificial Sequence
  Synthetic
ucauuauaacacugcuuu

SEQ ID NO: 27090 - RNA, 19 nt, Artificial Sequence
  Synthetic
uucauuauaacacugcuuu

SEQ ID NO: 27091 - RNA, 20 nt, Artificial Sequence
  Synthetic
cuucauuauaacacugcuuu

SEQ ID NO: 27092 - RNA, 21 nt, Artificial Sequence
  Synthetic
ucuucauuauaacacugcuuu

SEQ ID NO: 27093 - RNA, 22 nt, Artificial Sequence
  Synthetic
cucuucauuauaacacugcuuu

SEQ ID NO: 27094 - RNA, 23 nt, Artificial Sequence
  Synthetic
gcucuucauuauaacacugcuuu

SEQ ID NO: 27095 - RNA, 24 nt, Artificial Sequence
  Synthetic
agcucuucauuauaacacugcuuu

SEQ ID NO: 27096 - RNA, 18 nt, Artificial Sequence
  Synthetic
auuuaacugaauaucuuu

SEQ ID NO: 27097 - RNA, 19 nt, Artificial Sequence
  Synthetic
aauuuaacugaauaucuuu

SEQ ID NO: 27098 - RNA, 21 nt, Artificial Sequence
  Synthetic
gaaauuuaacugaauaucuuu

SEQ ID NO: 27099 - RNA, 22 nt, Artificial Sequence
  Synthetic
agaaauuuaacugaauaucuuu

SEQ ID NO: 27100 - RNA, 23 nt, Artificial Sequence
  Synthetic
uagaaauuuaacugaauaucuuu

SEQ ID NO: 27101 - RNA, 24 nt, Artificial Sequence
  Synthetic
auagaaauuuaacugaauaucuuu

SEQ ID NO: 27102 - RNA, 18 nt, Artificial Sequence
  Synthetic
ucaauauuuuggaauuuu

SEQ ID NO: 27103 - RNA, 19 nt, Artificial Sequence
  Synthetic
aucaauauuuuggaauuuu

SEQ ID NO: 27104 - RNA, 21 nt, Artificial Sequence
  Synthetic
uuaucaauauuuuggaauuuu

SEQ ID NO: 27105 - RNA, 22 nt, Artificial Sequence
  Synthetic
uuuaucaauauuuuggaauuuu

SEQ ID NO: 27106 - RNA, 23 nt, Artificial Sequence
  Synthetic
uuuuaucaauauuuuggaauuuu

SEQ ID NO: 27107 - RNA, 24 nt, Artificial Sequence
  Synthetic
guuuuaucaauauuuuggaauuuu

SEQ ID NO: 27108 - RNA, 18 nt, Artificial Sequence
  Synthetic
gauaaaaucagugcuuuu

SEQ ID NO: 27109 - RNA, 19 nt, Artificial Sequence
  Synthetic
ugauaaaaucagugcuuuu

SEQ ID NO: 27110 - RNA, 20 nt, Artificial Sequence
  Synthetic
cugauaaaaucagugcuuuu

SEQ ID NO: 27111 - RNA, 21 nt, Artificial Sequence
  Synthetic
ucugauaaaaucagugcuuuu

SEQ ID NO: 27112 - RNA, 22 nt, Artificial Sequence
  Synthetic
cucugauaaaaucagugcuuuu

SEQ ID NO: 27113 - RNA, 23 nt, Artificial Sequence
  Synthetic
gcucugauaaaaucagugcuuuu

SEQ ID NO: 27114 - RNA, 24 nt, Artificial Sequence
  Synthetic
agcucugauaaaaucagugcuuuu

SEQ ID NO: 27115 - RNA, 18 nt, Artificial Sequence
  Synthetic
uuaaaauuuuauucuuuu

SEQ ID NO: 27116 - RNA, 19 nt, Artificial Sequence
  Synthetic
uuuaaaauuuuauucuuuu

SEQ ID NO: 27117 - RNA, 20 nt, Artificial Sequence
  Synthetic
uuuuaaaauuuuauucuuuu

SEQ ID NO: 27118 - RNA, 21 nt, Artificial Sequence
  Synthetic
uuuuuaaaauuuuauucuuuu

SEQ ID NO: 27119 - RNA, 22 nt, Artificial Sequence
  Synthetic
auuuuuaaaauuuuauucuuuu

SEQ ID NO: 27120 - RNA, 23 nt, Artificial Sequence
  Synthetic
aauuuuuaaaauuuuauucuuuu

SEQ ID NO: 27121 - RNA, 24 nt, Artificial Sequence
  Synthetic
uaauuuuuaaaauuuuauucuuuu

SEQ ID NO: 27122 - RNA, 18 nt, Artificial Sequence
  Synthetic
aucauuuugaccauuuuu

SEQ ID NO: 27123 - RNA, 19 nt, Artificial Sequence
  Synthetic
uaucauuuugaccauuuuu

SEQ ID NO: 27124 - RNA, 20 nt, Artificial Sequence
  Synthetic
uuaucauuuugaccauuuuu

SEQ ID NO: 27125 - RNA, 21 nt, Artificial Sequence
  Synthetic
uuuaucauuuugaccauuuuu

SEQ ID NO: 27126 - RNA, 22 nt, Artificial Sequence
  Synthetic
auuuaucauuuugaccauuuuu

SEQ ID NO: 27127 - RNA, 23 nt, Artificial Sequence
  Synthetic
aauuuaucauuuugaccauuuuu

SEQ ID NO: 27128 - RNA, 24 nt, Artificial Sequence
  Synthetic
aaauuuaucauuuugaccauuuuu

SEQ ID NO: 27129 - RNA, 18 nt, Artificial Sequence
  Synthetic
auuaguaguuaaguuuuu

SEQ ID NO: 27130 - RNA, 19 nt, Artificial Sequence
  Synthetic
uauuaguaguuaaguuuuu

SEQ ID NO: 27131 - RNA, 20 nt, Artificial Sequence
  Synthetic
cuauuaguaguuaaguuuuu

SEQ ID NO: 27132 - RNA, 21 nt, Artificial Sequence
  Synthetic
gcuauuaguaguuaaguuuuu

SEQ ID NO: 27133 - RNA, 22 nt, Artificial Sequence
  Synthetic
ggcuauuaguaguuaaguuuuu

SEQ ID NO: 27134 - RNA, 23 nt, Artificial Sequence
  Synthetic
aggcuauuaguaguuaaguuuuu

SEQ ID NO: 27135 - RNA, 24 nt, Artificial Sequence
  Synthetic
uaggcuauuaguaguuaaguuuuu

SEQ ID NO: 27136 - RNA, 18 nt, Artificial Sequence
  Synthetic
aacacuuuauaguuuuuu

SEQ ID NO: 27137 - RNA, 19 nt, Artificial Sequence
  Synthetic
gaacacuuuauaguuuuuu

SEQ ID NO: 27138 - RNA, 20 nt, Artificial Sequence
  Synthetic
ggaacacuuuauaguuuuuu

SEQ ID NO: 27139 - RNA, 21 nt, Artificial Sequence
  Synthetic
uggaacacuuuauaguuuuuu

SEQ ID NO: 27140 - RNA, 22 nt, Artificial Sequence
  Synthetic
auggaacacuuuauaguuuuuu

SEQ ID NO: 27141 - RNA, 23 nt, Artificial Sequence
  Synthetic
aauggaacacuuuauaguuuuuu

SEQ ID NO: 27142 - RNA, 24 nt, Artificial Sequence
  Synthetic
gaauggaacacuuuauaguuuuuu

SEQ ID NO: 27143 - RNA, 18 nt, Artificial Sequence
  Synthetic
uuuuuuuuuuuuuuuuuu

SEQ ID NO: 27144 - RNA, 19 nt, Artificial Sequence
  Synthetic
uuuuuuuuuuuuuuuuuuu

SEQ ID NO: 27145 - RNA, 20 nt, Artificial Sequence
  Synthetic
uuuuuuuuuuuuuuuuuuuu

SEQ ID NO: 27146 - RNA, 21 nt, Artificial Sequence
  Synthetic
uuuuuuuuuuuuuuuuuuuuu

SEQ ID NO: 27147 - RNA, 22 nt, Artificial Sequence
  Synthetic
uuuuuuuuuuuuuuuuuuuuuu

SEQ ID NO: 27148 - RNA, 23 nt, Artificial Sequence
  Synthetic
uuuuuuuuuuuuuuuuuuuuuuu

SEQ ID NO: 27149 - RNA, 24 nt, Artificial Sequence
  Synthetic
cuuuuuuuuuuuuuuuuuuuuuuu

SEQ ID NO: 27150 - RNA, 17 nt, Artificial Sequence
  Synthetic
ggugaagucuuuaguaa

SEQ ID NO: 27151 - RNA, 17 nt, Artificial Sequence
  Synthetic
guuggugauauuuuuca

SEQ ID NO: 27152 - RNA, 17 nt, Artificial Sequence
  Synthetic
gucaagcauuuguguac

SEQ ID NO: 27153 - RNA, 17 nt, Artificial Sequence
  Synthetic
gauacaucugaaaaaau

SEQ ID NO: 27154 - RNA, 17 nt, Artificial Sequence
  Synthetic
ggaguguaaaggaaauu

SEQ ID NO: 27155 - RNA, 20 nt, Artificial Sequence
  Synthetic
ggggaauaauaaaaaaugua

SEQ ID NO: 27156 - RNA, 20 nt, Artificial Sequence
  Synthetic
gguuuacccccuaccuccac

SEQ ID NO: 27157 - RNA, 20 nt, Artificial Sequence
  Synthetic
guggucaagcauuuguguac

SEQ ID NO: 27158 - RNA, 20 nt, Artificial Sequence
  Synthetic
gguagcagaggaagaaaaag

SEQ ID NO: 27159 - RNA, 20 nt, Artificial Sequence
  Synthetic
gccauacacucuaaauagag

SEQ ID NO: 27160 - RNA, 20 nt, Artificial Sequence
  Synthetic
guuuucuagaaaaucuguag

SEQ ID NO: 27161 - RNA, 20 nt, Artificial Sequence
  Synthetic
ggagauacaucugaaaaaau

SEQ ID NO: 27162 - RNA, 20 nt, Artificial Sequence
  Synthetic
gcaggaagacagcuggcuau

SEQ ID NO: 27163 - RNA, 17 nt, Artificial Sequence
  Synthetic
uagagauuacuuggaaa

SEQ ID NO: 27164 - RNA, 17 nt, Artificial Sequence
  Synthetic
agucacagaggagucaa

SEQ ID NO: 27165 - RNA, 17 nt, Artificial Sequence
  Synthetic
aaaggacuaucagugaa

SEQ ID NO: 27166 - RNA, 17 nt, Artificial Sequence
  Synthetic
acugaauaucuuuagga

SEQ ID NO: 27167 - RNA, 17 nt, Artificial Sequence
  Synthetic
uuacccccuaccuccac

SEQ ID NO: 27168 - RNA, 17 nt, Artificial Sequence
  Synthetic
ucauuaggaaaauguac

SEQ ID NO: 27169 - RNA, 17 nt, Artificial Sequence
  Synthetic
aaugguuccuuguuccc

SEQ ID NO: 27170 - RNA, 17 nt, Artificial Sequence
  Synthetic
aaacuugucuucuuuuc

SEQ ID NO: 27171 - RNA, 17 nt, Artificial Sequence
  Synthetic
uccuaaccucgaaaaag

SEQ ID NO: 27172 - RNA, 17 nt, Artificial Sequence
  Synthetic
auacacucuaaauagag

SEQ ID NO: 27173 - RNA, 17 nt, Artificial Sequence
  Synthetic
uucuagaaaaucuguag

SEQ ID NO: 27174 - RNA, 17 nt, Artificial Sequence
  Synthetic
aaggcuuauuucucugg

SEQ ID NO: 27175 - RNA, 17 nt, Artificial Sequence
  Synthetic
caaauuguauugagugg

SEQ ID NO: 27176 - RNA, 17 nt, Artificial Sequence
  Synthetic
uauauauaugacacuau

SEQ ID NO: 27177 - RNA, 17 nt, Artificial Sequence
  Synthetic
cuacuaaaaggcagccu

SEQ ID NO: 27178 - RNA, 17 nt, Artificial Sequence
  Synthetic
ugauccuuuugcagccu

SEQ ID NO: 27179 - RNA, 17 nt, Artificial Sequence
  Synthetic
cuuuccaugaauuagcu

SEQ ID NO: 27180 - RNA, 17 nt, Artificial Sequence
  Synthetic
auuuccaaguaaucucu

SEQ ID NO: 27181 - RNA, 17 nt, Artificial Sequence
  Synthetic
uucguguaguuucuauu

SEQ ID NO: 27182 - RNA, 20 nt, Artificial Sequence
  Synthetic
aaaagucacagaggagucaa

SEQ ID NO: 27183 - RNA, 20 nt, Artificial Sequence
  Synthetic
acaaaaggacuaucagugaa

SEQ ID NO: 27184 - RNA, 20 nt, Artificial Sequence
  Synthetic
ugaguuggugauauuuuuca

SEQ ID NO: 27185 - RNA, 20 nt, Artificial Sequence
  Synthetic
uuaacugaauaucuuuagga

SEQ ID NO: 27186 - RNA, 20 nt, Artificial Sequence
  Synthetic
aauaaaguaauagaagcaua

SEQ ID NO: 27187 - RNA, 20 nt, Artificial Sequence
  Synthetic
aaagcucuuucucaucucua

SEQ ID NO: 27188 - RNA, 20 nt, Artificial Sequence
  Synthetic
ucuaugauauaaugaaucac

SEQ ID NO: 27189 - RNA, 20 nt, Artificial Sequence
  Synthetic
uaaaaugguuccuuguuccc

SEQ ID NO: 27190 - RNA, 20 nt, Artificial Sequence
  Synthetic
uggaaacuugucuucuuuuc

SEQ ID NO: 27191 - RNA, 20 nt, Artificial Sequence
  Synthetic
uagugugaagauggggcugg

SEQ ID NO: 27192 - RNA, 20 nt, Artificial Sequence
  Synthetic
uaccaaauuguauugagugg

SEQ ID NO: 27193 - RNA, 20 nt, Artificial Sequence
  Synthetic
auacuacuaaaaggcagccu

SEQ ID NO: 27194 - RNA, 20 nt, Artificial Sequence
  Synthetic
uauauuuccaaguaaucucu

SEQ ID NO: 27195 - RNA, 20 nt, Artificial Sequence
  Synthetic
uguggaguguaaaggaaauu

SEQ ID NO: 27196 - RNA, 20 nt, Artificial Sequence
  Synthetic
auauucguguaguuucuauu

SEQ ID NO: 27197 - RNA, 17 nt, Artificial Sequence
  Synthetic
gcucuuucucaucucua

SEQ ID NO: 27198 - RNA, 17 nt, Artificial Sequence
  Synthetic
gaauaauaaaaaaugua

SEQ ID NO: 27199 - RNA, 17 nt, Artificial Sequence
  Synthetic
gauacuaaaaaaaguua

SEQ ID NO: 27200 - RNA, 17 nt, Artificial Sequence
  Synthetic
gugcaacuaucaccucc

SEQ ID NO: 27201 - RNA, 17 nt, Artificial Sequence
  Synthetic
guggaggcugcagugag

SEQ ID NO: 27202 - RNA, 17 nt, Artificial Sequence
  Synthetic
gagaacugcucacacgg

SEQ ID NO: 27203 - RNA, 17 nt, Artificial Sequence
  Synthetic
ggaagacagcuggcuau

SEQ ID NO: 27204 - RNA, 20 nt, Artificial Sequence
  Synthetic
gaagauacuaaaaaaaguua

SEQ ID NO: 27205 - RNA, 20 nt, Artificial Sequence
  Synthetic
guugugcaacuaucaccucc

SEQ ID NO: 27206 - RNA, 20 nt, Artificial Sequence
  Synthetic
gaaguggaggcugcagugag

SEQ ID NO: 27207 - RNA, 20 nt, Artificial Sequence
  Synthetic
gcaucacuaguggcacuuug

SEQ ID NO: 27208 - RNA, 20 nt, Artificial Sequence
  Synthetic
gauaaauuuuaacuuuuuau

SEQ ID NO: 27209 - RNA, 17 nt, Artificial Sequence
  Synthetic
cuuuggaauuuguuaaa

SEQ ID NO: 27210 - RNA, 17 nt, Artificial Sequence
  Synthetic
acccaaaugucaaucaa

SEQ ID NO: 27211 - RNA, 17 nt, Artificial Sequence
  Synthetic
uaccaucaccuugggaa

SEQ ID NO: 27212 - RNA, 17 nt, Artificial Sequence
  Synthetic
uguauuuauauucauaa

SEQ ID NO: 27213 - RNA, 17 nt, Artificial Sequence
  Synthetic
auauagaaaugagguaa

SEQ ID NO: 27214 - RNA, 17 nt, Artificial Sequence
  Synthetic
cauauauauauuuuuaa

SEQ ID NO: 27215 - RNA, 17 nt, Artificial Sequence
  Synthetic
cuuugaaggaagaucca

SEQ ID NO: 27216 - RNA, 17 nt, Artificial Sequence
  Synthetic
aaaguaauagaagcaua

SEQ ID NO: 27217 - RNA, 17 nt, Artificial Sequence
  Synthetic
uggagucaaaaauuaua

SEQ ID NO: 27218 - RNA, 17 nt, Artificial Sequence
  Synthetic
uuaauaacaaaaucuua

SEQ ID NO: 27219 - RNA, 17 nt, Artificial Sequence
  Synthetic
augauauaaugaaucac

SEQ ID NO: 27220 - RNA, 17 nt, Artificial Sequence
  Synthetic
cacacauauauacauac

SEQ ID NO: 27221 - RNA, 17 nt, Artificial Sequence
  Synthetic
uccaagaucaaggugcc

SEQ ID NO: 27222 - RNA, 17 nt, Artificial Sequence
  Synthetic
caaauauaaaucaaagc

SEQ ID NO: 27223 - RNA, 17 nt, Artificial Sequence
  Synthetic
agcagaggaagaaaaag

SEQ ID NO: 27224 - RNA, 17 nt, Artificial Sequence
  Synthetic
aauguugaauaauaggg

SEQ ID NO: 27225 - RNA, 17 nt, Artificial Sequence
  Synthetic
ugugaagauggggcugg

SEQ ID NO: 27226 - RNA, 17 nt, Artificial Sequence
  Synthetic
cucugccuccaaaagug

SEQ ID NO: 27227 - RNA, 17 nt, Artificial Sequence
  Synthetic
cucggccucccaaagug

SEQ ID NO: 27228 - RNA, 17 nt, Artificial Sequence
  Synthetic
uaguauaguaggaagug

SEQ ID NO: 27229 - RNA, 17 nt, Artificial Sequence
  Synthetic
ucacuaguggcacuuug

SEQ ID NO: 27230 - RNA, 17 nt, Artificial Sequence
  Synthetic
uccacaaauauuuuuug

SEQ ID NO: 27231 - RNA, 17 nt, Artificial Sequence
  Synthetic
aaagaucuagcuaaaau

SEQ ID NO: 27232 - RNA, 17 nt, Artificial Sequence
  Synthetic
aaauuuuaacuuuuuau

SEQ ID NO: 27233 - RNA, 17 nt, Artificial Sequence
  Synthetic
uuuauugauacuuuucu

SEQ ID NO: 27234 - RNA, 17 nt, Artificial Sequence
  Synthetic
aaagacuugcaggaggu

SEQ ID NO: 27235 - RNA, 17 nt, Artificial Sequence
  Synthetic
uuucuuuuucuguuugu

SEQ ID NO: 27236 - RNA, 17 nt, Artificial Sequence
  Synthetic
uggguauauuuuauauu

SEQ ID NO: 27237 - RNA, 17 nt, Artificial Sequence
  Synthetic
caguaguauuaucuuuu

SEQ ID NO: 27238 - RNA, 17 nt, Artificial Sequence
  Synthetic
uaaaauuuuauucuuuu

SEQ ID NO: 27239 - RNA, 20 nt, Artificial Sequence
  Synthetic
uuauagagauuacuuggaaa

SEQ ID NO: 27240 - RNA, 20 nt, Artificial Sequence
  Synthetic
auacuuuggaauuuguuaaa

SEQ ID NO: 27241 - RNA, 20 nt, Artificial Sequence
  Synthetic
acaacccaaaugucaaucaa

SEQ ID NO: 27242 - RNA, 20 nt, Artificial Sequence
  Synthetic
caauaccaucaccuugggaa

SEQ ID NO: 27243 - RNA, 20 nt, Artificial Sequence
  Synthetic
uuuuguauuuauauucauaa

SEQ ID NO: 27244 - RNA, 20 nt, Artificial Sequence
  Synthetic
uuuauauagaaaugagguaa

SEQ ID NO: 27245 - RNA, 20 nt, Artificial Sequence
  Synthetic
augcauauauauauuuuuaa

SEQ ID NO: 27246 - RNA, 20 nt, Artificial Sequence
  Synthetic
augcuuugaaggaagaucca

SEQ ID NO: 27247 - RNA, 20 nt, Artificial Sequence
  Synthetic
uuguggagucaaaaauuaua

SEQ ID NO: 27248 - RNA, 20 nt, Artificial Sequence
  Synthetic
agacacacauauauacauac

SEQ ID NO: 27249 - RNA, 20 nt, Artificial Sequence
  Synthetic
aacucauuaggaaaauguac

SEQ ID NO: 27250 - RNA, 20 nt, Artificial Sequence
  Synthetic
aaguccaagaucaaggugcc

SEQ ID NO: 27251 - RNA, 20 nt, Artificial Sequence
  Synthetic
aaacaaauauaaaucaaagc

SEQ ID NO: 27252 - RNA, 20 nt, Artificial Sequence
  Synthetic
aucuccuaaccucgaaaaag

SEQ ID NO: 27253 - RNA, 20 nt, Artificial Sequence
  Synthetic
agagagaacugcucacacgg

SEQ ID NO: 27254 - RNA, 20 nt, Artificial Sequence
  Synthetic
auaaauguugaauaauaggg

SEQ ID NO: 27255 - RNA, 20 nt, Artificial Sequence
  Synthetic
ugccucugccuccaaaagug

SEQ ID NO: 27256 - RNA, 20 nt, Artificial Sequence
  Synthetic
aaguaguauaguaggaagug

SEQ ID NO: 27257 - RNA, 20 nt, Artificial Sequence
  Synthetic
uccuccacaaauauuuuuug

SEQ ID NO: 27258 - RNA, 20 nt, Artificial Sequence
  Synthetic
acaaaagaucuagcuaaaau

SEQ ID NO: 27259 - RNA, 20 nt, Artificial Sequence
  Synthetic
acauauauauaugacacuau

SEQ ID NO: 27260 - RNA, 20 nt, Artificial Sequence
  Synthetic
acaugauccuuuugcagccu

SEQ ID NO: 27261 - RNA, 20 nt, Artificial Sequence
  Synthetic
aagcuuuccaugaauuagcu

SEQ ID NO: 27262 - RNA, 20 nt, Artificial Sequence
  Synthetic
uccuuuauugauacuuuucu

SEQ ID NO: 27263 - RNA, 20 nt, Artificial Sequence
  Synthetic
cucuuucuuuuucuguuugu

SEQ ID NO: 27264 - RNA, 20 nt, Artificial Sequence
  Synthetic
uuuuggguauauuuuauauu

SEQ ID NO: 27265 - RNA, 20 nt, Artificial Sequence
  Synthetic
agucaguaguauuaucuuuu

SEQ ID NO: 27266 - DNA, 1200 bp, Artificial Sequence
  Synthetic
aaaatacaaaaaattagccagacgtgatggcgggtgcccgtagtcccagctactcgggaggctgaggcaggagaatggcgtgaacccaggaggcagaacttgcagtgagccgagatcgcgccactgcactctagcctgggtgacagagtgagactctgtctctaaataaataaataaataaataaataaataaataaaatcagtgctttttcttcctctgctacctcctttccttctactcagttttagtcagtagtattatcttttttcagatttatctttgtattgttaaatctgcttatgcttctattactttatttattagctttaaatgataccttttgactttcagcttttcttaataaagcaatcagcaaatttcctttacactccacacttataccccatttcctttgtttgtttatttggtttttacttctaacttttcttattgtcaggacatataacatatttaaactttgtttttcaactcgaattctgccattagttttaatttttgttcacagttatataaatctttgttcactgatagtccttttgtactatcatctcttaaatgactttatactccaagaaaggctcatgggaacaatattacctgaatatgtctctattacttaatctgtacctaataatatgaaggtaatctactttgtaggatttctgtgaagattaaataaattaatatagttaaagcacatagaacagcactcgacacagagtgagcacttggcaactgttagctgttactaacctttcccattcttcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcat

SEQ ID NO: 27267 - DNA, 1200 bp, Artificial Sequence
  Synthetic
tggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtgaatggatcaattaataaaacacatgacctatgctttaagaagcttgcaaacacatgaaataaatgcaatttattttttaaataatgggttcatttgatcacaataaatgcattttatgaaatggtgagaattttgttcactcattagtgagacaaacgtcctcaatggttatttatatggcatgcatataagtgatatgtggtatctttttaaaagataccacaaaatatgcatctttaaaaatatactccaaaaattattaagattattttaataattttaataatactatagcctaatggaatgagcattgatctgccagcagagaattagaggggtaaaattgtgaagatattgtatccctggctttgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttgtgattcaaaagcaatatctttgatagttggcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttggacttacctcaaagaggatatacttcattcctcaaaaggccttcttccaggaatagtatttcataacct

SEQ ID NO: 27268 - DNA, 2403 bp, Artificial Sequence
  Synthetic
aaaatacaaaaaattagccagacgtgatggcgggtgcccgtagtcccagctactcgggaggctgaggcaggagaatggcgtgaacccaggaggcagaacttgcagtgagccgagatcgcgccactgcactctagcctgggtgacagagtgagactctgtctctaaataaataaataaataaataaataaataaataaaatcagtgctttttcttcctctgctacctcctttccttctactcagttttagtcagtagtattatcttttttcagatttatctttgtattgttaaatctgcttatgcttctattactttatttattagctttaaatgataccttttgactttcagcttttcttaataaagcaatcagcaaatttcctttacactccacacttataccccatttcctttgtttgtttatttggtttttacttctaacttttcttattgtcaggacatataacatatttaaactttgtttttcaactcgaattctgccattagttttaatttttgttcacagttatataaatctttgttcactgatagtccttttgtactatcatctcttaaatgactttatactccaagaaaggctcatgggaacaatattacctgaatatgtctctattacttaatctgtacctaataatatgaaggtaatctactttgtaggatttctgtgaagattaaataaattaatatagttaaagcacatagaacagcactcgacacagagtgagcacttggcaactgttagctgttactaacctttcccattcttcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtgaatggatcaattaataaaacacatgacctatgctttaagaagcttgcaaacacatgaaataaatgcaatttattttttaaataatgggttcatttgatcacaataaatgcattttatgaaatggtgagaattttgttcactcattagtgagacaaacgtcctcaatggttatttatatggcatgcatataagtgatatgtggtatctttttaaaagataccacaaaatatgcatctttaaaaatatactccaaaaattattaagattattttaataattttaataatactatagcctaatggaatgagcattgatctgccagcagagaattagaggggtaaaattgtgaagatattgtatccctggctttgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttgtgattcaaaagcaatatctttgatagttggcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttggacttacctcaaagaggatatacttcattcctcaaaaggccttcttccaggaatagtatttcataacct

SEQ ID NO: 27269 - DNA, 1631 bp, Artificial Sequence
  Synthetic
aacctttcccattcttcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtgaatggatcaattaataaaacacatgacctatgctttaagaagcttgcaaacacatgaaataaatgcaatttattttttaaataatgggttcatttgatcacaataaatgcattttatgaaatggtgagaattttgttcactcattagtgagacaaacgtcctcaatggttatttatatggcatgcatataagtgatatgtggtatctttttaaaagataccacaaaatatgcatctttaaaaatatactccaaaaattattaagattattttaataattttaataatactatagcctaatggaatgagcattgatctgccagcagagaattagaggggtaaaattgtgaagatattgtatccctggctttgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttgtgattcaaaagcaatatctttgatagttggcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttggacttacctcaaagaggatatacttcattcctcaaaaggccttcttccaggaatagtatttcataacct

SEQ ID NO: 27270 - DNA, 1003 bp, Artificial Sequence
  Synthetic
aattaatatagttaaagcacatagaacagcactcgacacagagtgagcacttggcaactgttagctgttactaacctttcccattcttcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtgaatggatcaattaataaaacacatgacctatgctttaagaagcttgcaaacacatgaaataaatgcaatttattttttaaataatgggttcatttgatcacaataaatgcattttatgaaatggtgagaattttgttcactcattagtgagacaaacgtcctcaatggttatttatatggcatgcatataagtgatatgtggtatctttttaaaagataccacaaaatatgcatctttaaaaatatactccaaaaattattaagattattttaataattttaataatactatagcctaatggaatgag

SEQ ID NO: 27271 - DNA, 153 bp, Artificial Sequence
  Synthetic
taagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgt

SEQ ID NO: 27272 - DNA, 1200 bp, Artificial Sequence
  Synthetic
tgtccatatggtagataaatggaacaaatgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttctt

SEQ ID NO: 27273 - DNA, 1200 bp, Artificial Sequence
  Synthetic
gagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaa

SEQ ID NO: 27274 - DNA, 2401 bp, Artificial Sequence
  Synthetic
tgtccatatggtagataaatggaacaaatgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaa

SEQ ID NO: 27275 - DNA, 1001 bp, Artificial Sequence
  Synthetic
cctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgat

SEQ ID NO: 27276 - DNA, 151 bp, Artificial Sequence
  Synthetic
aaaagtgactctctaattttctatttttggtaataggacatctccaagtttgcagagaaagacaatatagttcttggagaaggtggaatcacactgagtggaggtcaacgagcaagaatttctttagcaaggtgaataactaattattggt

SEQ ID NO: 27277 - DNA, 2401 bp, Artificial Sequence
  Synthetic
tgtccatatggtagataaatggaacaaatgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttctaggtgaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaa

SEQ ID NO: 27278 - DNA, 1001 bp, Artificial Sequence
  Synthetic
cctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttctaggtgaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgat

SEQ ID NO: 27279 - DNA, 151 bp, Artificial Sequence
  Synthetic
aaaagtgactctctaattttctatttttggtaataggacatctccaagtttgcagagaaagacaatatagttctaggtgaaggtggaatcacactgagtggaggtcaacgagcaagaatttctttagcaaggtgaataactaattattggt

SEQ ID NO: 27280 - DNA, 1200 bp, Artificial Sequence
  Synthetic
tgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggag

SEQ ID NO: 27281 - DNA, 1200 bp, Artificial Sequence
  Synthetic
tcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagag

SEQ ID NO: 27282 - DNA, 2401 bp, Artificial Sequence
  Synthetic
tgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagag

SEQ ID NO: 27283 - DNA, 1544 bp, Artificial Sequence
  Synthetic
aatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacagga

SEQ ID NO: 27284 - DNA, 1001 bp, Artificial Sequence
  Synthetic
agtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatattt

SEQ ID NO: 27285 - DNA, 151 bp, Artificial Sequence
  Synthetic
ggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcatt

SEQ ID NO: 27286 - DNA, 2401 bp, Artificial Sequence
  Synthetic
tgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgtctggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagag

SEQ ID NO: 27287 - DNA, 1001 bp, Artificial Sequence
  Synthetic
agtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgtctggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatattt

SEQ ID NO: 27288 - DNA, 151 bp, Artificial Sequence
  Synthetic
ggtaataggacatctccaagtttgcagagaaagacaatatagttcttggagaaggtggaatcacactgtctggaggtcaacgagcaagaatttctttagcaaggtgaataactaattattggtctagcaagcatttgctgtaaatgtcatt

SEQ ID NO: 27289 - DNA, 1200 bp, Artificial Sequence
  Synthetic
gtttctgagacatttgacaacaactttttctttaagtcatcagttatgccccggggtatgaaatttctaacatgatcctcagtaaacttggctgccttgctgaggatactctccatctgcctgagagacacagacaccattaattgggaattgacttgacttgtgtggttccttgtggaccagatggccactaaatattctcatttcaaggcaattggtaaaaactacacttcaagaaatttcattcttaattccccttagtggatgttattaaccaaaggcaaaagaaaaaaagggtaaaaaaaatattctaaatgttaatatcaaaaatattattttcaattcaccccaggcacagagaactaagtattattattgctattgcaccggcattccccaatgagacagtgattttcttttaagacatttttaaataatataggcagaattaagtagacggtgatctggtaagtagatgtttcagggtaacagctgtgcaatgctccatgcagggaattagattgtcattttattccttaccaggaacatacattcagttaaacaattatttgacttctgctcttccactgatttctaagttgaggctctctcttgtgcctgtctgatcagataagtagagttgtgccttggtttatagatgagataaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaa

SEQ ID NO: 27290 - DNA, 1200 bp, Artificial Sequence
  Synthetic
ttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaagtcaaagatcaaggtgccagcaggtttgctgtctcgtgagagcatacttcctggttcattgatggtgctttcttgctgtgtcctcacataatggaaagggcaagacctctctggtgtctcttttacaatggcactaatcccatcatgagggctttgttctcatgacctaatcacctcccacatgtcctacattctaatactatcaccttgggggttaggattttaacatatgaatttgaggaggtggcgggggggacacaaatatttagaccatagcatttcactcctgacctccaaagttcatgtcttcttcacatgcaaaatacattcattccatcccaatagcccccaaagtcttaacttgttccagcatcaacttacaaggctaaagtccaaggtttcatctaaatatcagctaaatcagcacaaacagctaaatcaggtagagtgggacttaaggtgtgattcctctttaggcagattgctctccaactatgaaattgtgaaatcaaacctattatgtactttcaaaataaaatggtgaaacaggcacaggctagacagtcccatttcaaaaaagagaaatagaaaagaaaaaaggagtgacaggtctctataagtctaaaactttaaggcttgagaataatttgctttgctttgcctccaggctcactggggtggtgtcttacctctggacacac

SEQ ID NO: 27291 - DNA, 2401 bp, Artificial Sequence
  Synthetic
gtttctgagacatttgacaacaactttttctttaagtcatcagttatgccccggggtatgaaatttctaacatgatcctcagtaaacttggctgccttgctgaggatactctccatctgcctgagagacacagacaccattaattgggaattgacttgacttgtgtggttccttgtggaccagatggccactaaatattctcatttcaaggcaattggtaaaaactacacttcaagaaatttcattcttaattccccttagtggatgttattaaccaaaggcaaaagaaaaaaagggtaaaaaaaatattctaaatgttaatatcaaaaatattattttcaattcaccccaggcacagagaactaagtattattattgctattgcaccggcattccccaatgagacagtgattttcttttaagacatttttaaataatataggcagaattaagtagacggtgatctggtaagtagatgtttcagggtaacagctgtgcaatgctccatgcagggaattagattgtcattttattccttaccaggaacatacattcagttaaacaattatttgacttctgctcttccactgatttctaagttgaggctctctcttgtgcctgtctgatcagataagtagagttgtgccttggtttatagatgagataaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaagtcaaagatcaaggtgccagcaggtttgctgtctcgtgagagcatacttcctggttcattgatggtgctttcttgctgtgtcctcacataatggaaagggcaagacctctctggtgtctcttttacaatggcactaatcccatcatgagggctttgttctcatgacctaatcacctcccacatgtcctacattctaatactatcaccttgggggttaggattttaacatatgaatttgaggaggtggcgggggggacacaaatatttagaccatagcatttcactcctgacctccaaagttcatgtcttcttcacatgcaaaatacattcattccatcccaatagcccccaaagtcttaacttgttccagcatcaacttacaaggctaaagtccaaggtttcatctaaatatcagctaaatcagcacaaacagctaaatcaggtagagtgggacttaaggtgtgattcctctttaggcagattgctctccaactatgaaattgtgaaatcaaacctattatgtactttcaaaataaaatggtgaaacaggcacaggctagacagtcccatttcaaaaaagagaaatagaaaagaaaaaaggagtgacaggtctctataagtctaaaactttaaggcttgagaataatttgctttgctttgcctccaggctcactggggtggtgtcttacctctggacacac

SEQ ID NO: 27292 - DNA, 1001 bp, Artificial Sequence
  Synthetic
tttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaag

SEQ ID NO: 27293 - DNA, 151 bp, Artificial Sequence
  Synthetic
agttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatg

SEQ ID NO: 27294 - DNA, 2401 bp, Artificial Sequence
  Synthetic
gtttctgagacatttgacaacaactttttctttaagtcatcagttatgccccggggtatgaaatttctaacatgatcctcagtaaacttggctgccttgctgaggatactctccatctgcctgagagacacagacaccattaattgggaattgacttgacttgtgtggttccttgtggaccagatggccactaaatattctcatttcaaggcaattggtaaaaactacacttcaagaaatttcattcttaattccccttagtggatgttattaaccaaaggcaaaagaaaaaaagggtaaaaaaaatattctaaatgttaatatcaaaaatattattttcaattcaccccaggcacagagaactaagtattattattgctattgcaccggcattccccaatgagacagtgattttcttttaagacatttttaaataatataggcagaattaagtagacggtgatctggtaagtagatgtttcagggtaacagctgtgcaatgctccatgcagggaattagattgtcattttattccttaccaggaacatacattcagttaaacaattatttgacttctgctcttccactgatttctaagttgaggctctctcttgtgcctgtctgatcagataagtagagttgtgccttggtttatagatgagataaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacctcgatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaagtcaaagatcaaggtgccagcaggtttgctgtctcgtgagagcatacttcctggttcattgatggtgctttcttgctgtgtcctcacataatggaaagggcaagacctctctggtgtctcttttacaatggcactaatcccatcatgagggctttgttctcatgacctaatcacctcccacatgtcctacattctaatactatcaccttgggggttaggattttaacatatgaatttgaggaggtggcgggggggacacaaatatttagaccatagcatttcactcctgacctccaaagttcatgtcttcttcacatgcaaaatacattcattccatcccaatagcccccaaagtcttaacttgttccagcatcaacttacaaggctaaagtccaaggtttcatctaaatatcagctaaatcagcacaaacagctaaatcaggtagagtgggacttaaggtgtgattcctctttaggcagattgctctccaactatgaaattgtgaaatcaaacctattatgtactttcaaaataaaatggtgaaacaggcacaggctagacagtcccatttcaaaaaagagaaatagaaaagaaaaaaggagtgacaggtctctataagtctaaaactttaaggcttgagaataatttgctttgctttgcctccaggctcactggggtggtgtcttacctctggacacac

SEQ ID NO: 27295 - DNA, 1001 bp, Artificial Sequence
  Synthetic
tttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacctcgatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaag

SEQ ID NO: 27296 - DNA, 151 bp, Artificial Sequence
  Synthetic
agttattcatactttcttcttcttttcttttttgctatagaaagtatttattttttctggaacatttagaaaaaacctcgatccctatgaacagtggagtgatcaagaaatatggaaagttgcagatgaggtaaggctgctaactgaaatg

SEQ ID NO: 27297 - DNA, 1200 bp, Artificial Sequence
  Synthetic
aacccctcaaattaagggatgaggcagaataatgcttggcaataccaggggtaggctgcagtctttcttggaaatatatattttaaatggaaccaattatcatagcatcatttcctctcagggttaccctctgatccctattttactaaatcgttataaaacaaaatgaggaattatgtgtccttcccttttgaagccaatgtaacaagatgggtaagaattagacctcctgagttcaaaatccctggattcagatctattcctgtatattcaggagaagtggtaataaattcgatggacaatttggtttagtagtcgattgaggaccctgatgaggtatatttgggaaaacataacttccgctctctctcattgactcacgggcctttgaggagtccaggagtcattggaatctggcctgaggttgaggctgctggcaaaactccttccccaaagtccattcctattgctgactgagaagggactagcattggaagtggctgattttaaataccgctagtgctggtgtgctcctccctcccattcccagctctgctttgtgtagttgccttgagaagctaagttcattctgaaaataatgccattgcacaaaacacttttgaaagttctagtttgaaattacatcaggtcacttggtctgtgtggcctcagtttcttcatctgccatgtgaaaataataatgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaac

SEQ ID NO: 27298 - DNA, 1200 bp, Artificial Sequence
  Synthetic
ctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgttcagcaagaagagtataatatatgattgttaatgataacccaaacaacaaaagatttcaccttaactggttgtcataagtagtagtatccaccgccttattttgagttggatttttatcatcctatgagccctacaaatttaaagtttttggaacagcacgtgcattgaacccataagaacctactctgcttttctgcatgtattgtccagacaagagaccaaattgccgaggcatcatttaggtgaattctaattaacatttagctaccttacaaccacaattcaaggttgtttcaaaggcatgtgcttgcatcatcctgattcactaccatgtgttactaacttggatctgcaaagtcattataaaaagctgttttgatggacttatttggatattgctttacccttcttctctcttttcttttatcaatgtaaaaacattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaa

SEQ ID NO: 27299 - DNA, 2401 bp, Artificial Sequence
  Synthetic
aacccctcaaattaagggatgaggcagaataatgcttggcaataccaggggtaggctgcagtctttcttggaaatatatattttaaatggaaccaattatcatagcatcatttcctctcagggttaccctctgatccctattttactaaatcgttataaaacaaaatgaggaattatgtgtccttcccttttgaagccaatgtaacaagatgggtaagaattagacctcctgagttcaaaatccctggattcagatctattcctgtatattcaggagaagtggtaataaattcgatggacaatttggtttagtagtcgattgaggaccctgatgaggtatatttgggaaaacataacttccgctctctctcattgactcacgggcctttgaggagtccaggagtcattggaatctggcctgaggttgaggctgctggcaaaactccttccccaaagtccattcctattgctgactgagaagggactagcattggaagtggctgattttaaataccgctagtgctggtgtgctcctccctcccattcccagctctgctttgtgtagttgccttgagaagctaagttcattctgaaaataatgccattgcacaaaacacttttgaaagttctagtttgaaattacatcaggtcacttggtctgtgtggcctcagtttcttcatctgccatgtgaaaataataatgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgttcagcaagaagagtataatatatgattgttaatgataacccaaacaacaaaagatttcaccttaactggttgtcataagtagtagtatccaccgccttattttgagttggatttttatcatcctatgagccctacaaatttaaagtttttggaacagcacgtgcattgaacccataagaacctactctgcttttctgcatgtattgtccagacaagagaccaaattgccgaggcatcatttaggtgaattctaattaacatttagctaccttacaaccacaattcaaggttgtttcaaaggcatgtgcttgcatcatcctgattcactaccatgtgttactaacttggatctgcaaagtcattataaaaagctgttttgatggacttatttggatattgctttacccttcttctctcttttcttttatcaatgtaaaaacattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaa

SEQ ID NO: 27300 - DNA, 1001 bp, Artificial Sequence
  Synthetic
atgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgt

SEQ ID NO: 27301 - DNA, 151 bp, Artificial Sequence
  Synthetic
aagtcaccaaagcagtacagcctctcttactgggaagaatcatagcttcctatgacccggataacaaggaggaacgctctatcgcgatttatctaggcataggcttatgccttctctttattgtgaggacactgctcctacacccagccat

SEQ ID NO: 27302 - DNA, 2401 bp, Artificial Sequence
  Synthetic
aacccctcaaattaagggatgaggcagaataatgcttggcaataccaggggtaggctgcagtctttcttggaaatatatattttaaatggaaccaattatcatagcatcatttcctctcagggttaccctctgatccctattttactaaatcgttataaaacaaaatgaggaattatgtgtccttcccttttgaagccaatgtaacaagatgggtaagaattagacctcctgagttcaaaatccctggattcagatctattcctgtatattcaggagaagtggtaataaattcgatggacaatttggtttagtagtcgattgaggaccctgatgaggtatatttgggaaaacataacttccgctctctctcattgactcacgggcctttgaggagtccaggagtcattggaatctggcctgaggttgaggctgctggcaaaactccttccccaaagtccattcctattgctgactgagaagggactagcattggaagtggctgattttaaataccgctagtgctggtgtgctcctccctcccattcccagctctgctttgtgtagttgccttgagaagctaagttcattctgaaaataatgccattgcacaaaacacttttgaaagttctagtttgaaattacatcaggtcacttggtctgtgtggcctcagtttcttcatctgccatgtgaaaataataatgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataataaagaagaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgttcagcaagaagagtataatatatgattgttaatgataacccaaacaacaaaagatttcaccttaactggttgtcataagtagtagtatccaccgccttattttgagttggatttttatcatcctatgagccctacaaatttaaagtttttggaacagcacgtgcattgaacccataagaacctactctgcttttctgcatgtattgtccagacaagagaccaaattgccgaggcatcatttaggtgaattctaattaacatttagctaccttacaaccacaattcaaggttgtttcaaaggcatgtgcttgcatcatcctgattcactaccatgtgttactaacttggatctgcaaagtcattataaaaagctgttttgatggacttatttggatattgctttacccttcttctctcttttcttttatcaatgtaaaaacattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaa

SEQ ID NO: 27303 - DNA, 1001 bp, Artificial Sequence
  Synthetic
atgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataataaagaagaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgt

SEQ ID NO: 27304 - DNA, 151 bp, Artificial Sequence
  Synthetic
aagtcaccaaagcagtacagcctctcttactgggaagaatcatagcttcctatgacccggataataaagaagaacgctctatcgcgatttatctaggcataggcttatgccttctctttattgtgaggacactgctcctacacccagccat

SEQ ID NO: 27305 - DNA, 1200 bp, Artificial Sequence
  Synthetic
tttttattatatatttttgaagtattgatatgtagtgaattagaaatttaaaaagaaaacaaaactgtccttcactacagattgaaaagcattatactaaaagaccatttgctcagttatagtatataaaggccaaatgacttaaaaacaaattatgtaaggagaaggaaacaaccatttattcagtgccactaactgtcagccagttttttcagtggtcagttaatgactgcagtagtgttctaccttgctcaaagcaccctcctcaagttctggcatctaagctgacatcagaacacagagttggggctctctgtgggtcacctctagcacttgatctcctcatgcagtgcatggtgctctcacgtctatgctatgttcttatggtctttaggtaacaagaataattttctttcttttccttactatacattttgctttctgaaattcccttctcgccaatccaggtgaatgtcagaatgtgatttgacaactgtccaaagtactcattcactgaggagtggtaaggccttcgcccaacctgccttctctgggaatatactgctgcctgaacatatcattgtttattgccaggcttgaacttcaccaaattaatttattagggtcaacatctaaatattagaactatttcagattaatttttaagtcgtatccactttgggtactagatcaaattgcaggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtg

SEQ ID NO: 27306 - DNA, 1200 bp, Artificial Sequence
  Synthetic
aggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaactatttttttttaatgtcactctgatttggtcacaaaggatctctagtctcattgccttagtatcattctacgaattagaatgtgttactgtgtaagagcacttcttgtatatgagagaaatagcaacagttccagtttaaagtgatataaatggaaaccaagaaatgtctttactgggaccaaatctggacagcatttactgtatttttgctggtattttctctagtctttccgggtatattcacatttaatgatcacttttctccctttgtgctaatggacactgaatccattccactaccatagttcttgctaatactactctactttttacacaaaattaaaatgccaggagcacctccaggtagactgactataaatctagactgaaaaaaaagcttgtatttcttaacagattaccttgtggaacatttgctcctttcaactaatgaggcactaaatattgtaactgctcaactggtgcttttaatttatttgtctagactttgtcatgttgccagaagctttatcctggttggagttttgaaaacagtattgtttcttcagaaagaaaaaagggattgtcagatgatctaaaaataaagaaacactggaaatacaagtatcccaaggtgatagcattaggcaagataaaaatgttgaaaagcgaaaaagaactggttgatagagaagtgttgttat

SEQ ID NO: 27307 - DNA, 2401 bp, Artificial Sequence
  Synthetic
tttttattatatatttttgaagtattgatatgtagtgaattagaaatttaaaaagaaaacaaaactgtccttcactacagattgaaaagcattatactaaaagaccatttgctcagttatagtatataaaggccaaatgacttaaaaacaaattatgtaaggagaaggaaacaaccatttattcagtgccactaactgtcagccagttttttcagtggtcagttaatgactgcagtagtgttctaccttgctcaaagcaccctcctcaagttctggcatctaagctgacatcagaacacagagttggggctctctgtgggtcacctctagcacttgatctcctcatgcagtgcatggtgctctcacgtctatgctatgttcttatggtctttaggtaacaagaataattttctttcttttccttactatacattttgctttctgaaattcccttctcgccaatccaggtgaatgtcagaatgtgatttgacaactgtccaaagtactcattcactgaggagtggtaaggccttcgcccaacctgccttctctgggaatatactgctgcctgaacatatcattgtttattgccaggcttgaacttcaccaaattaatttattagggtcaacatctaaatattagaactatttcagattaatttttaagtcgtatccactttgggtactagatcaaattgcaggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaactatttttttttaatgtcactctgatttggtcacaaaggatctctagtctcattgccttagtatcattctacgaattagaatgtgttactgtgtaagagcacttcttgtatatgagagaaatagcaacagttccagtttaaagtgatataaatggaaaccaagaaatgtctttactgggaccaaatctggacagcatttactgtatttttgctggtattttctctagtctttccgggtatattcacatttaatgatcacttttctccctttgtgctaatggacactgaatccattccactaccatagttcttgctaatactactctactttttacacaaaattaaaatgccaggagcacctccaggtagactgactataaatctagactgaaaaaaaagcttgtatttcttaacagattaccttgtggaacatttgctcctttcaactaatgaggcactaaatattgtaactgctcaactggtgcttttaatttatttgtctagactttgtcatgttgccagaagctttatcctggttggagttttgaaaacagtattgtttcttcagaaagaaaaaagggattgtcagatgatctaaaaataaagaaacactggaaatacaagtatcccaaggtgatagcattaggcaagataaaaatgttgaaaagcgaaaaagaactggttgatagagaagtgttgttat

SEQ ID NO: 27308 - DNA, 1001 bp, Artificial Sequence
  Synthetic
ggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaacta

SEQ ID NO: 27309 - DNA, 150 bp, Artificial Sequence
  Synthetic
tttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatatttt

SEQ ID NO: 27310 - DNA, 2401 bp, Artificial Sequence
  Synthetic
tttttattatatatttttgaagtattgatatgtagtgaattagaaatttaaaaagaaaacaaaactgtccttcactacagattgaaaagcattatactaaaagaccatttgctcagttatagtatataaaggccaaatgacttaaaaacaaattatgtaaggagaaggaaacaaccatttattcagtgccactaactgtcagccagttttttcagtggtcagttaatgactgcagtagtgttctaccttgctcaaagcaccctcctcaagttctggcatctaagctgacatcagaacacagagttggggctctctgtgggtcacctctagcacttgatctcctcatgcagtgcatggtgctctcacgtctatgctatgttcttatggtctttaggtaacaagaataattttctttcttttccttactatacattttgctttctgaaattcccttctcgccaatccaggtgaatgtcagaatgtgatttgacaactgtccaaagtactcattcactgaggagtggtaaggccttcgcccaacctgccttctctgggaatatactgctgcctgaacatatcattgtttattgccaggcttgaacttcaccaaattaatttattagggtcaacatctaaatattagaactatttcagattaatttttaagtcgtatccactttgggtactagatcaaattgcaggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggagaaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaactatttttttttaatgtcactctgatttggtcacaaaggatctctagtctcattgccttagtatcattctacgaattagaatgtgttactgtgtaagagcacttcttgtatatgagagaaatagcaacagttccagtttaaagtgatataaatggaaaccaagaaatgtctttactgggaccaaatctggacagcatttactgtatttttgctggtattttctctagtctttccgggtatattcacatttaatgatcacttttctccctttgtgctaatggacactgaatccattccactaccatagttcttgctaatactactctactttttacacaaaattaaaatgccaggagcacctccaggtagactgactataaatctagactgaaaaaaaagcttgtatttcttaacagattaccttgtggaacatttgctcctttcaactaatgaggcactaaatattgtaactgctcaactggtgcttttaatttatttgtctagactttgtcatgttgccagaagctttatcctggttggagttttgaaaacagtattgtttcttcagaaagaaaaaagggattgtcagatgatctaaaaataaagaaacactggaaatacaagtatcccaaggtgatagcattaggcaagataaaaatgttgaaaagcgaaaaagaactggttgatagagaagtgttgttat

SEQ ID NO: 27311 - DNA, 1001 bp, Artificial Sequence
  Synthetic
ggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggagaaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaacta

SEQ ID NO: 27312 - DNA, 1200 bp, Artificial Sequence
  Synthetic
aacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaa

SEQ ID NO: 27313 - DNA, 1200 bp, Artificial Sequence
  Synthetic
gagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagagtatat

SEQ ID NO: 27314 - DNA, 2401 bp, Artificial Sequence
  Synthetic
aacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagagtatat

SEQ ID NO: 27315 - DNA, 1001 bp, Artificial Sequence
  Synthetic
ctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaat

SEQ ID NO: 27316 - DNA, 151 bp, Artificial Sequence
  Synthetic
taggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgt

SEQ ID NO: 27317 - DNA, 2401 bp, Artificial Sequence
  Synthetic
aacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgtcaggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagagtatat

SEQ ID NO: 27318 - DNA, 1001 bp, Artificial Sequence
  Synthetic
ctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgtcaggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaat

SEQ ID NO: 27319 - DNA, 151 bp, Artificial Sequence
  Synthetic
taggacatctccaagtttgcagagaaagacaatatagttcttggagaaggtggaatcacactgtcaggaggtcaacgagcaagaatttctttagcaaggtgaataactaattattggtctagcaagcatttgctgtaaatgtcattcatgt

SEQ ID NO: 27320 - DNA, 1200 bp, Artificial Sequence
  Synthetic
tttttctgtttcattctgtggtaaaggtatcatttggctaattgtataatttcagtgtcatttctaatattccaattgtgatagtatcaacacaagattaaatttctctacatggtttatgagaatggaatgccaaattgaaatagaacagagcacagatgatctaaatataaaaagaactacaaaaatcacagttgtttaaaaaggttttttgtttgtttatatatggtgcagaacatttgttccttagccaaatgtttccaccttgagaaagctatagagattctatgtagtcctagtaccaataatatgttttaacctgaatgtaccttatctttattcataaactgtgactttttacactgctgaaacttttttttttaagacaatctcactctgtcgtccagtctggagtgcagcagtggtgtgatcttggctcactgcaacctctaccttctgtgttcaagcaattctggtgcctcggccacctgagtagttgggatcacaggtgtacaccaccaggcctggctaatagtttttgatatttctagtagagatgagttttgccacattggccaggctggcctgaaactcctggcctcaagtgatctgcctgccttggcctcccaaagtgttggtattacaagtgtgagccactgtgcctggcctgaaactcataattcatttccattaatattaatctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtga

SEQ ID NO: 27321 - DNA, 1200 bp, Artificial Sequence
  Synthetic
tattccatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatatctattttcttgcaataatagtatgattttgaggttaagggtgcatgctcttctaatgcaaaatattgtatttatttagactcaagtttagttccatttacatgtattggaaattcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctggcttttgcacagaggcatgtgccctttgttgaacctccatttgactggcatgcacatgtctcagatattataggttatcatatattgttgctcctaatatttctgtgttagataattagagtagcttggtttgtaagaatgtgatgttggtgggactgtagcagaacaagaaggcccttatgggtcagtcatacctctctt

SEQ ID NO: 27322 - DNA, 2401 bp, Artificial Sequence
  Synthetic
tttttctgtttcattctgtggtaaaggtatcatttggctaattgtataatttcagtgtcatttctaatattccaattgtgatagtatcaacacaagattaaatttctctacatggtttatgagaatggaatgccaaattgaaatagaacagagcacagatgatctaaatataaaaagaactacaaaaatcacagttgtttaaaaaggttttttgtttgtttatatatggtgcagaacatttgttccttagccaaatgtttccaccttgagaaagctatagagattctatgtagtcctagtaccaataatatgttttaacctgaatgtaccttatctttattcataaactgtgactttttacactgctgaaacttttttttttaagacaatctcactctgtcgtccagtctggagtgcagcagtggtgtgatcttggctcactgcaacctctaccttctgtgttcaagcaattctggtgcctcggccacctgagtagttgggatcacaggtgtacaccaccaggcctggctaatagtttttgatatttctagtagagatgagttttgccacattggccaggctggcctgaaactcctggcctcaagtgatctgcctgccttggcctcccaaagtgttggtattacaagtgtgagccactgtgcctggcctgaaactcataattcatttccattaatattaatctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatatctattttcttgcaataatagtatgattttgaggttaagggtgcatgctcttctaatgcaaaatattgtatttatttagactcaagtttagttccatttacatgtattggaaattcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctggcttttgcacagaggcatgtgccctttgttgaacctccatttgactggcatgcacatgtctcagatattataggttatcatatattgttgctcctaatatttctgtgttagataattagagtagcttggtttgtaagaatgtgatgttggtgggactgtagcagaacaagaaggcccttatgggtcagtcatacctctctt

SEQ ID NO: 27323 - DNA, 1001 bp, Artificial Sequence
  Synthetic
tctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatat

SEQ ID NO: 27324 - DNA, 151 bp, Artificial Sequence
  Synthetic
aaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgta

SEQ ID NO: 27325 - DNA, 2401 bp, Artificial Sequence
  Synthetic
tttttctgtttcattctgtggtaaaggtatcatttggctaattgtataatttcagtgtcatttctaatattccaattgtgatagtatcaacacaagattaaatttctctacatggtttatgagaatggaatgccaaattgaaatagaacagagcacagatgatctaaatataaaaagaactacaaaaatcacagttgtttaaaaaggttttttgtttgtttatatatggtgcagaacatttgttccttagccaaatgtttccaccttgagaaagctatagagattctatgtagtcctagtaccaataatatgttttaacctgaatgtaccttatctttattcataaactgtgactttttacactgctgaaacttttttttttaagacaatctcactctgtcgtccagtctggagtgcagcagtggtgtgatcttggctcactgcaacctctaccttctgtgttcaagcaattctggtgcctcggccacctgagtagttgggatcacaggtgtacaccaccaggcctggctaatagtttttgatatttctagtagagatgagttttgccacattggccaggctggcctgaaactcctggcctcaagtgatctgcctgccttggcctcccaaagtgttggtattacaagtgtgagccactgtgcctggcctgaaactcataattcatttccattaatattaatctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattggatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatatctattttcttgcaataatagtatgattttgaggttaagggtgcatgctcttctaatgcaaaatattgtatttatttagactcaagtttagttccatttacatgtattggaaattcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctggcttttgcacagaggcatgtgccctttgttgaacctccatttgactggcatgcacatgtctcagatattataggttatcatatattgttgctcctaatatttctgtgttagataattagagtagcttggtttgtaagaatgtgatgttggtgggactgtagcagaacaagaaggcccttatgggtcagtcatacctctctt

SEQ ID NO: 27326 - DNA, 1001 bp, Artificial Sequence
  Synthetic
tctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattggatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatat

SEQ ID NO: 27327 - DNA, 151 bp, Artificial Sequence
  Synthetic
aaaaaaaatcaactgtgtcttgttccattccaggtggctgcttctttggttgtgctgtggctccttggaaagtgagtattggatgtcctattgtgtagattgtgttttatttctgttgattaaatattgtaatccactatgtttgtatgta

SEQ ID NO: 27328 - DNA, 1200 bp, Artificial Sequence
  Synthetic
gtgcacatgtaccctaaaacttaaagtataataaaaaaaataaaaaaaagtttgaggtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgtgtatataaaaggaaactatattacaaagtacacatggattttttttcttaattaatgaccatgtgacttcattttggttttaaaataggtatatagaatcttaccacagttggtgtacaggacattcatttataataaacttatatcagtcaaattaaacaaggatagtgctgctattactaaaggtttctctgggttcccaaatgatacttgaccaaatttgtccctttggcttgttgtcttcagacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgca

SEQ ID NO: 27329 - DNA, 1200 bp, Artificial Sequence
  Synthetic
tgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatatacatatatatatatagtattatccctgttttcacagttttaaaaaccgatgcacacagattgtcagatagcaattctgtgattgaaggggaaatatgtcacctcttcatactcatattggtgaagggtcctagcttcaaaattaatagattcctaaagaggggaaatgaaacatccgcatttacacacacacacacacacacacacacagagttcctcttgtcggtaagttttgttttttttaaatctctactagataaaatttgttatctaattgtgagttttacacaaagaaaaactgtcacagaaaagaaagacagtgtcacatttttcaaaagaaaaagaagaaaagaaagtgccatgtttttcaaatacaaatgttctggattgattttaggatctttagtgaaaaacaaagtatttcataataagtaaaataaaaatctatgtaggtaaatttgtttctctaatttaagaatttgaatttctgagtatttatgataagtgttgaaataacttcttatatgtgacagtgaatactggcagagcaaatgccaaatcaatgccaaatctgtaggatcatttgattgtaggaacagaattctactcaaaccgaaagcaggcatttgctggagttacagaaaggcctcatggaacaccgagaaggtggtgccattcgactcttaaagaagctgcaacaggca

SEQ ID NO: 27330 - DNA, 2401 bp, Artificial Sequence
  Synthetic
gtgcacatgtaccctaaaacttaaagtataataaaaaaaataaaaaaaagtttgaggtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgtgtatataaaaggaaactatattacaaagtacacatggattttttttcttaattaatgaccatgtgacttcattttggttttaaaataggtatatagaatcttaccacagttggtgtacaggacattcatttataataaacttatatcagtcaaattaaacaaggatagtgctgctattactaaaggtttctctgggttcccaaatgatacttgaccaaatttgtccctttggcttgttgtcttcagacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatatacatatatatatatagtattatccctgttttcacagttttaaaaaccgatgcacacagattgtcagatagcaattctgtgattgaaggggaaatatgtcacctcttcatactcatattggtgaagggtcctagcttcaaaattaatagattcctaaagaggggaaatgaaacatccgcatttacacacacacacacacacacacacacagagttcctcttgtcggtaagttttgttttttttaaatctctactagataaaatttgttatctaattgtgagttttacacaaagaaaaactgtcacagaaaagaaagacagtgtcacatttttcaaaagaaaaagaagaaaagaaagtgccatgtttttcaaatacaaatgttctggattgattttaggatctttagtgaaaaacaaagtatttcataataagtaaaataaaaatctatgtaggtaaatttgtttctctaatttaagaatttgaatttctgagtatttatgataagtgttgaaataacttcttatatgtgacagtgaatactggcagagcaaatgccaaatcaatgccaaatctgtaggatcatttgattgtaggaacagaattctactcaaaccgaaagcaggcatttgctggagttacagaaaggcctcatggaacaccgagaaggtggtgccattcgactcttaaagaagctgcaacaggca

SEQ ID NO: 27331 - DNA, 1001 bp, Artificial Sequence
  Synthetic
agacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatataca

SEQ ID NO: 27332 - DNA, 151 bp, Artificial Sequence
  Synthetic
atatgattattctaatttagtctttttcaggtacaagatattatgaaattacattttgtgtttatgttatttgcaatgttttctatggaaatatttcacaggcaggagtccaattttcactcatcttgttacaagcttaaaaggactatgg

SEQ ID NO: 27333 - DNA, 2401 bp, Artificial Sequence
  Synthetic
gtgcacatgtaccctaaaacttaaagtataataaaaaaaataaaaaaaagtttgaggtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgtgtatataaaaggaaactatattacaaagtacacatggattttttttcttaattaatgaccatgtgacttcattttggttttaaaataggtatatagaatcttaccacagttggtgtacaggacattcatttataataaacttatatcagtcaaattaaacaaggatagtgctgctattactaaaggtttctctgggttcccaaatgatacttgaccaaatttgtccctttggcttgttgtcttcagacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatccaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatatacatatatatatatagtattatccctgttttcacagttttaaaaaccgatgcacacagattgtcagatagcaattctgtgattgaaggggaaatatgtcacctcttcatactcatattggtgaagggtcctagcttcaaaattaatagattcctaaagaggggaaatgaaacatccgcatttacacacacacacacacacacacacacagagttcctcttgtcggtaagttttgttttttttaaatctctactagataaaatttgttatctaattgtgagttttacacaaagaaaaactgtcacagaaaagaaagacagtgtcacatttttcaaaagaaaaagaagaaaagaaagtgccatgtttttcaaatacaaatgttctggattgattttaggatctttagtgaaaaacaaagtatttcataataagtaaaataaaaatctatgtaggtaaatttgtttctctaatttaagaatttgaatttctgagtatttatgataagtgttgaaataacttcttatatgtgacagtgaatactggcagagcaaatgccaaatcaatgccaaatctgtaggatcatttgattgtaggaacagaattctactcaaaccgaaagcaggcatttgctggagttacagaaaggcctcatggaacaccgagaaggtggtgccattcgactcttaaagaagctgcaacaggca

SEQ ID NO: 27334 - DNA, 1001 bp, Artificial Sequence
  Synthetic
agacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatccaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatataca

SEQ ID NO: 27335 - DNA, 151 bp, Artificial Sequence
  Synthetic
atatgattattctaatttagtctttttcaggtacaagatattatgaaattacattttgtgtttatgttatttgcaatgttttctatccaaatatttcacaggcaggagtccaattttcactcatcttgttacaagcttaaaaggactatgg

SEQ ID NO: 27336 - DNA, 23 bp, Artificial Sequence
  Synthetic
ctcaagtgatctgcccaccttgg

SEQ ID NO: 27337 - DNA, 2400 bp, Artificial Sequence
  Synthetic
caatcaaaaggttaggatccttttgattgccagtgacagaaacccaatttactagcttaagtaaataaaaggaacgaatttattggctcatgaagcctgaactatgtgaagacctaggtggagaactggccttaggaactcaatgggaccaaggactcaaatgccacctggtggcatttgccttatgctggttttattttctcagaccggaccagctttctacataaagtgggtccctggttagaactctttgctcctatctttaaggaccacgaaagaaggagccctttgtccttggctaaatgtgaaaaatcccagagactcttgagtcatagtgcttaccccttgggccactcatagtctagaatgaactaggctgagtctcgtgccaacagcacaggcctgatgccagataaaagggtgagtgaagggggataaaaaataagacatagctactaaattattgcaccaaagtaaaaacattgagttgacttgcaatttgtttcttttaattaaattcatttcctttttttggcattttgaaggcaaagtaagatattaaactttatttttattgattttattcaaagaattaagctagtgggagtagcagattcacacttctaagatcaagggccagcttctattattgaacacttggtgtgtgcaaatgccatgaggtagggatactttgttttgttttttattttttattgggttcgatctcttttgtttatgatgtatccccaagtgcctagaatagggcctggcatatggtatatactcaataaatatttgttgaatgaatccatgatggaatgtgaaatggctagcattacatagaaacctgtagcattgctggagagataaaatatataaacataatccattgcaggtatattgacaagttcaaaataatataatgggtattgaatatctaaatgtttgttgttgttgttgctgttgtttttgagacagagtcttgctctgttgcccaggctggagtgtaatggtgcaattttggctcactgcaaacttcgtctcctgggttcaagtgattctcctgcctcagcctctcgagtagctgggtttacaggcactcgccacaatgcctggctaatttttgtattttagtagatgtggagtttcgccatgttggccaggctggtcttgaactcctgacctcaagtgatctgcccaccttaacctcccaaaatgctgggattataggtgtgagccactatgcccagctttgaatatctaagttttaattggatgctgagggaatgattaatcagagtagggctgggttaattgaaaaatgtgatacatttgtatttatggccagatagagaacatgaatctgaatttgcagaattatctggcttaacatttttttctttccagttttcactgtatcccccatgttgattcaatttaaaaaatatacctattttacttcaattcaacaatgctatgccagtacaaacccatacgttctattatttttgttttgttttgtttttgtatctccaccctgttacttcttttcttataaaattggtatttgaaatttattgaaatattttggaagagtgacataccatttttggtactttgtacctctgcacccttgggaagtgaccctggcttcacatttcataactgccttgtgaccatggccctcaagtggttgccagatggttgaagaacattaacctatctggctcaattttgtgaccatggattgaatcctctacataactgcagtgtgcaaaccacacatccgttccaagattgtagtcaggatatgaactttttaagaataaaacttcttcccttctgatctgggcctggtatgtggtcctactagaaccacatcacctactcttggtgctaacaatttgtggcaccaagttgttcaagtttcacccattaaagaaattccccgaccttgccttctcctcaggtaactaccccattctattttttctttcatagctaacattctctgctctcctggtctctctacttcactttcatttacatctcagctcctgaagtatggtttccaccatgttcctaaaactacattgcccagggtcactagagacctcttatgaaatataacaacacctttctacattacttccgtgtggaccactttttcacattgaacccattttgttggtttatgtacacaccccttccttggctttcccatctgatccatttctcctttgatggagaaggtgagtctgctccatatttagcttcttactctgagtaaccaaatgttatggatgggaggttagctctgtgtgtgagagaaaggtggagaagcatgtggggagggaaatagatgggaaaaggtaattaggctttatagaagggctctca

SEQ ID NO: 27338 - DNA, 4279 bp, Artificial Sequence
  Synthetic
agaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttag

SEQ ID NO: 27339 - DNA, 1000 bp, Artificial Sequence
  Synthetic
tttttattttttattgggttcgatctcttttgtttatgatgtatccccaagtgcctagaatagggcctggcatatggtatatactcaataaatatttgttgaatgaatccatgatggaatgtgaaatggctagcattacatagaaacctgtagcattgctggagagataaaatatataaacataatccattgcaggtatattgacaagttcaaaataatataatgggtattgaatatctaaatgtttgttgttgttgttgctgttgtttttgagacagagtcttgctctgttgcccaggctggagtgtaatggtgcaattttggctcactgcaaacttcgtctcctgggttcaagtgattctcctgcctcagcctctcgagtagctgggtttacaggcactcgccacaatgcctggctaatttttgtattttagtagatgtggagtttcgccatgttggccaggctggtcttgaactcctgacctcaagtgatctgcccaccttaacctcccaaaatgctgggattataggtgtgagccactatgcccagctttgaatatctaagttttaattggatgctgagggaatgattaatcagagtagggctgggttaattgaaaaatgtgatacatttgtatttatggccagatagagaacatgaatctgaatttgcagaattatctggcttaacatttttttctttccagttttcactgtatcccccatgttgattcaatttaaaaaatatacctattttacttcaattcaacaatgctatgccagtacaaacccatacgttctattatttttgttttgttttgtttttgtatctccaccctgttacttcttttcttataaaattggtatttgaaatttattgaaatattttggaagagtgacataccatttttggtactttgtacctctgcacccttgggaagtgaccctggcttcacatttcataactgccttgtgaccatggccctcaagtggttgccag

SEQ ID NO: 27340 - DNA, 23 bp, Artificial Sequence
  Synthetic
agtgaatgaatgtggtatcccgg

SEQ ID NO: 27341 - DNA, 2400 bp, Artificial Sequence
  Synthetic
ctaaatagagtgctgatttccccacagcattactaacagatgatattatctaatttaaaaagtttctcatcttatagggaaaatagtatgtcaatgtattcttaacttgcatttcttttattataagtagtgtaaaatatcatttcaacttatacacaggaggaatttctctctatataaagtgatcctagaatcataatgaaaaatatcaccaactcattaggaaaatgtacaaaggattgaatagatatctcatcaaaaataaaaatataagtggcctttaaacattgaaaggtaacatttgaacaaagacttgcaggaggtgagggattagggaatgcagactctgggaagagtcttccaagtagcaggtgaagcaagtgcaaagctttcagatgggactgactatacctgtctggtttgaagaacagtaaggaggtcactgaggctggcatagagtaagacagggagggtagaatactgtcagagaagtaatcggcggtggaggtagggggtaaaccataaagtgctcgtaaagactaaggcttatttctctgggtgagattagaggccactggagagttttaaacagaagtaacagggccactttggctaatgtttttaggctattctgtagggagacaagggaggaagcaaggagatgagttaggagtctattgtgccagttcaggcaagtgatgatggtggcttgatccaggtagtagtggaagtagtatagtaggaagtgatcagattcaggacatgctttgaaggaagatccaataggattaatggataagttgaacaatggcatatgagaaaagtcacagaggagtcaaagatgattccaagctttctggactgagtaactggaaggataaatgtgccgtttactagaaagataatgggagaaacaggttttggatggagcttggtttgggaatattaagtttgaaatgcctatttgacatccaaatagagatgttagttggatgtacaagtctagtttcaaggaagagggggctggtagtgtgaagatggggctggataagattctaaaggaaagagggttgataagaagagaaaggggtgtaggggttagcctaagggcattctaagtattagaggttaaggaggtgggtgaagaaaacccaataaaataaaagtctgagaagacaaagctagtgaatgaatgtggtatcccttaacccaactgatgtcaagcagaagggtgttatcaactaggtcaaatgctcattcatcaagtaagatgaaactgttataattaaccggtgtcttctgaaatacggagataactcgtgacttaatgaaagcaatagtagagaaggtcaaacttgaccagaatgaaattagaaagaataagaggaaagaaaagaccaaatacagacaaccattgatgccttattcttttgatatactcctggagtccacttgctaatacaattgacccttaaacaatacaggcttgaactgcatgggtccacttatttgtgaattttttttcagttaatacattggaaaatttttggggttttttgacaatttgaaaaaactcacaaactgtctagcctagaaataccgagaaaattaagaaaaagtaagatatgccatgaatgcataaaatatatgtagacactagcctattttatcatttgctactataaaatatacacaatctattataaaaagttaaaatttatcaaaacttaacacacactaacacctaccctacctggcaccattcacagtaaagagaaatgtaaataaacataaaaatgtagtattaaaccataatggcataaaactaattgtagtacatatggtactactgtaataatttggaagccacttcctgttgctattacggtaagctcaagcattgtggatagccatttaaaacaccacgtgatgctaatcatctccgtgtgagcagttctctctccagtaaattgcatattgcagtaaaaagtgatctctagtggttctcgcatatttttcatcatgtttagtgcaatgccataaaccttgaataacatcaagcaatccatacaaagtgccactagtgatgcacggaaaagttgtaacagtacaagaaaaaagttgagttgcttggtatttaccatatattgaggtctgcagctacagttgcctgcaatttcgagataaatgaacccagtataaagactgttgtaacaaaagaaaagaaaatgtgaaaccatcagtgcagctatgccagcaggtgtgaagtcttgcactttttgcaaaatacaaaatatgaaatatgtgttaattgactgtttatgttatctgtaaggtttccactcaacaataggctattagtagttaagtttttgtggagtcaaaaattatacgtggatt

SEQ ID NO: 27342 - DNA, 3051 bp, Artificial Sequence
  Synthetic
acttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttag

SEQ ID NO: 27343 - DNA, 1000 bp, Artificial Sequence
  Synthetic
gatggtggcttgatccaggtagtagtggaagtagtatagtaggaagtgatcagattcaggacatgctttgaaggaagatccaataggattaatggataagttgaacaatggcatatgagaaaagtcacagaggagtcaaagatgattccaagctttctggactgagtaactggaaggataaatgtgccgtttactagaaagataatgggagaaacaggttttggatggagcttggtttgggaatattaagtttgaaatgcctatttgacatccaaatagagatgttagttggatgtacaagtctagtttcaaggaagagggggctggtagtgtgaagatggggctggataagattctaaaggaaagagggttgataagaagagaaaggggtgtaggggttagcctaagggcattctaagtattagaggttaaggaggtgggtgaagaaaacccaataaaataaaagtctgagaagacaaagctagtgaatgaatgtggtatcccttaacccaactgatgtcaagcagaagggtgttatcaactaggtcaaatgctcattcatcaagtaagatgaaactgttataattaaccggtgtcttctgaaatacggagataactcgtgacttaatgaaagcaatagtagagaaggtcaaacttgaccagaatgaaattagaaagaataagaggaaagaaaagaccaaatacagacaaccattgatgccttattcttttgatatactcctggagtccacttgctaatacaattgacccttaaacaatacaggcttgaactgcatgggtccacttatttgtgaattttttttcagttaatacattggaaaatttttggggttttttgacaatttgaaaaaactcacaaactgtctagcctagaaataccgagaaaattaagaaaaagtaagatatgccatgaatgcataaaatatatgtagacactagcctattttatcatttgctactataaaatatacacaatcta
